US011208697B2

(12) United States Patent
Davicioni et al.

(10) Patent No.: US 11,208,697 B2
(45) Date of Patent: Dec. 28, 2021

(54) MOLECULAR SUBTYPING, PROGNOSIS, AND TREATMENT OF BLADDER CANCER

(71) Applicants: DECIPHER BIOSCIENCES, INC., San Diego, CA (US); THE UNIVERSITY OF BRITISH COLUMBIA, Vancouver (CA)

(72) Inventors: Elai Davicioni, La Jolla, CA (US); Hussam Al-Deen Ashab, Ontario (CA); Nicholas Erho, Vancouver (CA); Peter Black, Vancouver (CA)

(73) Assignees: Decipher Biosciences, Inc., San Diego, CA (US); The University of British Columbia, Vancouver (CA)

( * ) Notice: Subject to any disclaimer, the term of this patent is extended or adjusted under 35 U.S.C. 154(b) by 155 days.

(21) Appl. No.: 15/875,871

(22) Filed: Jan. 19, 2018

(65) Prior Publication Data
US 2018/0216197 A1    Aug. 2, 2018

Related U.S. Application Data

(60) Provisional application No. 62/448,921, filed on Jan. 20, 2017.

(51) Int. Cl.
| C12Q 1/6886 | (2018.01) |
| G16H 50/20 | (2018.01) |
| G16H 20/10 | (2018.01) |
| G16H 50/70 | (2018.01) |
| G16H 20/40 | (2018.01) |
| G16H 50/50 | (2018.01) |
| G16H 50/30 | (2018.01) |
| C12Q 1/6811 | (2018.01) |
| C12Q 1/6809 | (2018.01) |

(52) U.S. Cl.
CPC .......... *C12Q 1/6886* (2013.01); *C12Q 1/6811* (2013.01); *G16H 20/10* (2018.01); *G16H 20/40* (2018.01); *G16H 50/20* (2018.01); *G16H 50/30* (2018.01); *G16H 50/50* (2018.01); *G16H 50/70* (2018.01); *C12Q 1/6809* (2013.01); *C12Q 2600/106* (2013.01); *C12Q 2600/112* (2013.01); *C12Q 2600/118* (2013.01); *C12Q 2600/158* (2013.01); *C12Q 2600/166* (2013.01)

(58) Field of Classification Search
None
See application file for complete search history.

(56) References Cited

U.S. PATENT DOCUMENTS

| 3,645,691 A | 2/1972 | Guenter et al. |
| 3,687,808 A | 8/1972 | Thomas, Jr. et al. |
| 4,323,546 A | 4/1982 | Crockfor et al. |
| 4,683,195 A | 7/1987 | Mullis et al. |
| 4,683,202 A | 7/1987 | Mullis et al. |
| 4,800,159 A | 1/1989 | Mullis et al. |
| 4,965,188 A | 10/1990 | Mullis et al. |
| 5,130,238 A | 7/1992 | Malek et al. |
| 5,143,854 A | 9/1992 | Pinung et al. |
| 5,225,326 A | 7/1993 | Bresser et al. |
| 5,270,184 A | 12/1993 | Walker et al. |
| 5,283,174 A | 2/1994 | Arnold et al. |
| 5,288,514 A | 2/1994 | Ellman |
| 5,384,261 A | 1/1995 | Winkle et al. |
| 5,399,491 A | 3/1995 | Kacian et al. |
| 5,455,166 A | 10/1995 | Walker |
| 5,480,784 A | 1/1996 | Kacian et al. |
| 5,494,810 A | 2/1996 | Barany et al. |
| 5,538,848 A | 7/1996 | Livak et al. |
| 5,545,524 A | 8/1996 | Trent et al. |
| 5,677,195 A | 10/1997 | Winkler et al. |
| 5,705,365 A | 1/1998 | Ryder et al. |
| 5,710,029 A | 1/1998 | Ryder et al. |
| 5,711,029 A | 1/1998 | Ryder et al. |
| 5,744,305 A | 4/1998 | Fodor et al. |
| 5,814,447 A | 9/1998 | Ishiguro et al. |
| 5,824,518 A | 10/1998 | Kacian et al. |
| 5,830,711 A | 11/1998 | Barany et al. |

(Continued)

FOREIGN PATENT DOCUMENTS

| EP | 0 684 315 | 11/1995 |
| EP | 1 409 727 | 11/2005 |

(Continued)

OTHER PUBLICATIONS

US 5,962,233 A, 10/1999, Livak et al. (withdrawn)
Choi et al. Identification of distinct basal and luminal subtypes of muscle-invasive bladder cancer with different sensitivities to frontline chemotherapy. Feb. 10, 2014. Cancer Cell. vol. 25, No. 2, pp. 152-165. (Year: 2014).*

(Continued)

*Primary Examiner* — Channing S Mahatan
(74) *Attorney, Agent, or Firm* — Knobbe, Martens, Olson & Bear, LLP

(57) ABSTRACT

The present invention relates to methods, systems and kits for the diagnosis, prognosis, and treatment of bladder cancer in a subject. The invention also provides biomarkers that define subgroups of bladder cancer, clinically useful classifiers for distinguishing bladder cancer subtypes, bioinformatic methods for determining clinically useful classifiers, and methods of use of each of the foregoing. The methods, systems and kits can provide expression-based analysis of biomarkers for purposes of subtyping bladder cancer in a subject. Further disclosed herein, in certain instances, are probe sets for use in subtyping bladder cancer in a subject. Classifiers for subtyping a bladder cancer are provided. Methods of treating bladder cancer based on molecular subtyping are also provided.

11 Claims, 40 Drawing Sheets

Specification includes a Sequence Listing.

(56) References Cited

U.S. PATENT DOCUMENTS

| | | |
|---|---|---|
| 5,846,717 A | 12/1998 | Brow et al. |
| 5,854,033 A | 12/1998 | Lizardi |
| 5,854,206 A | 12/1998 | Twardzik et al. |
| 5,888,779 A | 3/1999 | Kacian et al. |
| 5,925,517 A | 7/1999 | Tyagi et al. |
| 5,928,862 A | 7/1999 | Morrison |
| 5,965,360 A | 10/1999 | Zain et al. |
| 5,985,557 A | 11/1999 | Prudent et al. |
| 5,989,815 A | 11/1999 | Skolnick et al. |
| 5,994,069 A | 11/1999 | Hall et al. |
| 6,001,567 A | 12/1999 | Brow et al. |
| 6,022,692 A | 2/2000 | Coulie et al. |
| 6,027,887 A | 2/2000 | Zavada et al. |
| 6,034,218 A | 3/2000 | Reed et al. |
| 6,090,543 A | 7/2000 | Prudent et al. |
| 6,121,489 A | 9/2000 | Dorner et al. |
| 6,136,182 A | 10/2000 | Dolan et al. |
| 6,150,097 A | 11/2000 | Tyagi et al. |
| 6,198,107 B1 | 3/2001 | Seville |
| 6,218,523 B1 | 4/2001 | French |
| 6,225,051 B1 | 5/2001 | Sugiyama et al. |
| 6,251,639 B1 | 6/2001 | Kurn |
| 6,262,245 B1 | 7/2001 | Xu et al. |
| 6,268,142 B1 | 7/2001 | Duff et al. |
| 6,303,305 B1 | 10/2001 | Wittwer et al. |
| 6,410,278 B1 | 6/2002 | Notomi et al. |
| 6,436,642 B1 | 8/2002 | Gould-Rothberg et al. |
| 6,541,205 B1 | 4/2003 | Yokoyama et al. |
| 6,573,043 B1 | 6/2003 | Cohen et al. |
| 6,630,358 B1 | 10/2003 | Wagner et al. |
| 6,723,506 B2 | 4/2004 | Fletcher et al. |
| 6,828,429 B1 | 12/2004 | Srivastava et al. |
| 7,008,765 B1 | 3/2006 | Bussemakers et al. |
| 7,186,514 B2 | 3/2007 | Zavada et al. |
| 7,211,390 B2 | 5/2007 | Rothberg et al. |
| 7,244,559 B2 | 7/2007 | Rothberg et al. |
| 7,264,929 B2 | 9/2007 | Rothberg et al. |
| 7,280,922 B2 | 10/2007 | Mei et al. |
| 7,300,788 B2 | 11/2007 | Matsuzaki et al. |
| 7,319,011 B2 | 1/2008 | Riggins et al. |
| 7,323,305 B2 | 1/2008 | Leamon et al. |
| 7,335,762 B2 | 2/2008 | Rothberg et al. |
| 7,358,061 B2 | 4/2008 | Yamamoto et al. |
| 7,361,488 B2 | 4/2008 | Fan et al. |
| 7,378,233 B2 | 5/2008 | Sidransky et al. |
| 7,407,755 B2 | 8/2008 | Lubinski et al. |
| 7,541,169 B2 | 6/2009 | Freimuth et al. |
| 7,598,052 B2 | 10/2009 | Giordanos et al. |
| 7,662,553 B2 | 2/2010 | Lenz et al. |
| 7,767,391 B2 | 8/2010 | Scott et al. |
| 7,901,881 B2 | 3/2011 | Libutti et al. |
| 7,901,888 B2 | 3/2011 | Kebebew |
| 7,914,988 B1 | 3/2011 | Chudin et al. |
| 7,927,826 B2 | 4/2011 | Riggins et al. |
| 8,008,009 B2 | 8/2011 | Choquet-Kastylevsky et al. |
| 8,202,692 B2 | 6/2012 | Giordano et al. |
| 8,273,539 B2 | 9/2012 | Klee et al. |
| 8,293,880 B2 | 10/2012 | Cote et al. |
| 8,299,233 B2 | 10/2012 | Andre et al. |
| 8,338,109 B2 | 12/2012 | Vasmatzis et al. |
| 8,354,228 B2 | 1/2013 | Ron |
| 8,465,914 B2 | 6/2013 | Brown et al. |
| 8,541,170 B2 | 9/2013 | Kennedy et al. |
| 8,568,971 B2 | 10/2013 | Brown et al. |
| 8,669,057 B2 | 3/2014 | Kennedy et al. |
| 8,802,599 B2 | 8/2014 | Aharonov et al. |
| 8,828,656 B2 | 9/2014 | Bullerdiek et al. |
| 8,877,445 B2 | 11/2014 | Shackney |
| 8,945,829 B2 | 2/2015 | Keutgen et al. |
| 9,040,286 B2 | 5/2015 | Zon et al. |
| 9,074,258 B2 | 7/2015 | Davicion et al. |
| 9,096,906 B2 | 8/2015 | Aharonov et al. |
| 9,157,123 B2 | 10/2015 | Xing |
| 9,175,352 B2 | 11/2015 | Keutgen et al. |
| 9,206,481 B2 | 12/2015 | Srivastava et al. |
| 9,206,482 B2 | 12/2015 | Davicioni et al. |
| 9,234,244 B2 | 1/2016 | Zeiger et al. |
| 9,435,812 B2 | 9/2016 | Pestano et al. |
| 9,495,515 B1 | 11/2016 | Giulia et al. |
| 9,534,249 B2 | 1/2017 | Vasmatzis et al. |
| 9,587,279 B2 | 3/2017 | Fahey, III et al. |
| 9,617,604 B2 | 4/2017 | Davicion et al. |
| 9,708,667 B2 | 7/2017 | Yanai et al. |
| 9,714,452 B2 | 7/2017 | Davicioni et al. |
| 9,856,537 B2 | 1/2018 | Kennedy et al. |
| 9,994,907 B2 | 6/2018 | Davicioni et al. |
| 10,114,924 B2 | 10/2018 | Kennedy et al. |
| 10,407,731 B2 | 9/2019 | Klee et al. |
| 10,422,009 B2 | 9/2019 | Davicioni et al. |
| 10,494,677 B2 | 12/2019 | Vasmatzis et al. |
| 10,865,452 B2 | 12/2020 | Davicioni |
| 2001/0051344 A1 | 12/2001 | Shalon et al. |
| 2002/0076735 A1 | 6/2002 | Williams et al. |
| 2002/0090633 A1 | 7/2002 | Becker et al. |
| 2002/0119463 A1 | 8/2002 | Fads |
| 2002/0168638 A1 | 11/2002 | Schlegel et al. |
| 2002/0169137 A1 | 11/2002 | Reiner et al. |
| 2002/0182586 A1 | 12/2002 | Morris et al. |
| 2003/0119168 A1 | 6/2003 | Madison et al. |
| 2003/0152980 A1 | 8/2003 | Golub et al. |
| 2003/0175736 A1 | 9/2003 | Chinnaiyan et al. |
| 2003/0185830 A1 | 10/2003 | Xu et al. |
| 2003/0186248 A1 | 10/2003 | Erlander et al. |
| 2003/0190602 A1 | 10/2003 | Pressman et al. |
| 2003/0194734 A1 | 10/2003 | Jatkoe |
| 2003/0224399 A1 | 12/2003 | Reed et al. |
| 2003/0235820 A1 | 12/2003 | Mack et al. |
| 2004/0009481 A1 | 1/2004 | Schlegel et al. |
| 2004/0018493 A1 | 1/2004 | Anastasio et al. |
| 2004/0019466 A1 | 1/2004 | Minor et al. |
| 2004/0029114 A1 | 2/2004 | Mack et al. |
| 2004/0058378 A1 | 3/2004 | Kong et al. |
| 2004/0259086 A1 | 12/2004 | Schlegel et al. |
| 2005/0042222 A1 | 2/2005 | Yamamoto et al. |
| 2005/0042638 A1 | 2/2005 | Arnold et al. |
| 2005/0048533 A1 | 3/2005 | Sidransky et al. |
| 2005/0064455 A1 | 3/2005 | Baker et al. |
| 2005/0118625 A1 | 6/2005 | Mounts |
| 2005/0137805 A1 | 6/2005 | Lewin et al. |
| 2005/0202442 A1 | 9/2005 | Morris et al. |
| 2005/0227917 A1 | 10/2005 | Williams et al. |
| 2005/0240357 A1 | 10/2005 | Minor |
| 2005/0250125 A1 | 11/2005 | Novakoff |
| 2005/0260646 A1 | 11/2005 | Baker et al. |
| 2005/0266443 A1 | 12/2005 | Croce et al. |
| 2005/0266459 A1 | 12/2005 | Poulsen |
| 2006/0019256 A1 | 1/2006 | Clarke et al. |
| 2006/0019615 A1 | 1/2006 | Ditmer |
| 2006/0035244 A1 | 2/2006 | Riggins et al. |
| 2006/0046253 A1 | 3/2006 | Nakao |
| 2006/0046265 A1 | 3/2006 | Becker et al. |
| 2006/0083744 A1 | 4/2006 | Chen et al. |
| 2006/0088851 A1 | 4/2006 | Erlander et al. |
| 2006/0094061 A1 | 5/2006 | Brys et al. |
| 2006/0105360 A1 | 5/2006 | Croce et al. |
| 2006/0127907 A1 | 6/2006 | Matsubara et al. |
| 2006/0134663 A1 | 6/2006 | Harkin et al. |
| 2006/0204989 A1 | 9/2006 | Kopreski |
| 2006/0211017 A1 | 9/2006 | Chinnaiyan et al. |
| 2007/0010469 A1 | 1/2007 | Chan |
| 2007/0020657 A1 | 1/2007 | Grebe et al. |
| 2007/0031873 A1 | 2/2007 | Wang et al. |
| 2007/0037165 A1 | 2/2007 | Venter et al. |
| 2007/0037186 A1 | 2/2007 | Jiang et al. |
| 2007/0048738 A1 | 3/2007 | Donkena et al. |
| 2007/0065827 A1 | 3/2007 | Pauloski et al. |
| 2007/0065833 A1 | 3/2007 | Gupta |
| 2007/0083334 A1 | 4/2007 | Mintz et al. |
| 2007/0099197 A1 | 5/2007 | Afar et al. |
| 2007/0099209 A1 | 5/2007 | Clarke et al. |
| 2007/0105133 A1 | 5/2007 | Clarke et al. |
| 2007/0148667 A1 | 6/2007 | Williams et al. |
| 2007/0148687 A1 | 6/2007 | Bedingham et al. |
| 2007/0161004 A1 | 7/2007 | Brown et al. |

(56) References Cited

U.S. PATENT DOCUMENTS

| | | |
|---|---|---|
| 2007/0172841 A1 | 7/2007 | Wang |
| 2007/0172844 A1 | 7/2007 | Lancaster et al. |
| 2007/0212702 A1 | 9/2007 | Tomlins et al. |
| 2007/0220621 A1 | 9/2007 | Clarke et al. |
| 2007/0238119 A1 | 10/2007 | Yu et al. |
| 2007/0259352 A1 | 11/2007 | Bentwich et al. |
| 2007/0275915 A1 | 11/2007 | Hallenbeck et al. |
| 2008/0009001 A1 | 1/2008 | Bettuzzi et al. |
| 2008/0028302 A1 | 1/2008 | Meschkat |
| 2008/0044824 A1 | 2/2008 | Giordano et al. |
| 2008/0076674 A1 | 3/2008 | Litman et al. |
| 2008/0124344 A1 | 5/2008 | Combs et al. |
| 2008/0131892 A1 | 6/2008 | Becker et al. |
| 2008/0145841 A1 | 6/2008 | Libutti et al. |
| 2008/0254470 A1 | 10/2008 | Berlkin |
| 2008/0269157 A1 | 10/2008 | Srivastava et al. |
| 2008/0274457 A1 | 11/2008 | Eng et al. |
| 2008/0281568 A1 | 11/2008 | Kao et al. |
| 2009/0020433 A1 | 1/2009 | Cohen et al. |
| 2009/0036415 A1 | 2/2009 | Rubin et al. |
| 2009/0062144 A1 | 3/2009 | Guo |
| 2009/0075921 A1 | 3/2009 | Ikegawa |
| 2009/0149333 A1 | 6/2009 | Knudsen et al. |
| 2009/0191535 A1 | 7/2009 | Connelly et al. |
| 2009/0204333 A1 | 8/2009 | Friend et al. |
| 2009/0239221 A1 | 9/2009 | Chinnaiyan et al. |
| 2009/0280490 A1 | 11/2009 | Baker et al. |
| 2009/0298082 A1 | 12/2009 | Klee et al. |
| 2010/0055704 A1 | 3/2010 | Giordano et al. |
| 2010/0075384 A1 | 3/2010 | Kong et al. |
| 2010/0099093 A1 | 4/2010 | Weaver et al. |
| 2010/0130377 A1 | 5/2010 | Vasmatzis et al. |
| 2010/0131286 A1 | 5/2010 | Houlgatte et al. |
| 2010/0131432 A1 | 5/2010 | Kennedy et al. |
| 2010/0178653 A1 | 7/2010 | Aharonov et al. |
| 2010/0021538 A1 | 8/2010 | Iljin et al. |
| 2010/0215638 A1 | 8/2010 | Ijin et al. |
| 2010/0257617 A1 | 10/2010 | Ami et al. |
| 2010/0279327 A1 | 11/2010 | Ossovskaya |
| 2010/0285979 A1 | 11/2010 | Zeiger et al. |
| 2011/0009286 A1 | 1/2011 | Andre et al. |
| 2011/0045462 A1 | 2/2011 | Fu et al. |
| 2011/0092375 A1 | 4/2011 | Zamore et al. |
| 2011/0136683 A1 | 6/2011 | Davicioni |
| 2011/0152110 A1 | 6/2011 | Vierlinger et al. |
| 2011/0178163 A1 | 7/2011 | Chowdhury |
| 2011/0212855 A1 | 9/2011 | Rafnar et al. |
| 2011/0229894 A1 | 9/2011 | Levy et al. |
| 2011/0230372 A1 | 9/2011 | Willman et al. |
| 2011/0236903 A1 | 9/2011 | McClelland |
| 2011/0287946 A1 | 11/2011 | Gudmundsson et al. |
| 2011/0294123 A1 | 12/2011 | Nakamura et al. |
| 2011/0312520 A1 | 12/2011 | Kennedy et al. |
| 2012/0015839 A1 | 1/2012 | Chinnaiyan |
| 2012/0015843 A1 | 1/2012 | Von et al. |
| 2012/0041274 A1 | 2/2012 | Stone et al. |
| 2012/0108453 A1 | 5/2012 | Smit et al. |
| 2012/0115743 A1 | 5/2012 | Davicioni et al. |
| 2012/0122698 A1 | 5/2012 | Stacey et al. |
| 2012/0122718 A1 | 5/2012 | Reisman |
| 2012/0157334 A1 | 6/2012 | Beaudenon-Huibregtse et al. |
| 2012/0172243 A1 | 7/2012 | Davicioni et al. |
| 2012/0214165 A1 | 8/2012 | Walfish et al. |
| 2012/0220474 A1 | 8/2012 | Kennedy et al. |
| 2012/0304318 A1 | 11/2012 | Ohnuma et al. |
| 2013/0004974 A1 | 1/2013 | Klee et al. |
| 2013/0023434 A1 | 1/2013 | Van |
| 2013/0142728 A1 | 6/2013 | Beaudenon-Huibregtse et al. |
| 2013/0150257 A1 | 6/2013 | Abdueva et al. |
| 2013/0172203 A1 | 7/2013 | Yeatman et al. |
| 2013/0184999 A1 | 7/2013 | Ding |
| 2013/0196866 A1 | 8/2013 | Pestano et al. |
| 2013/0225662 A1 | 8/2013 | Kennedy et al. |
| 2013/0231258 A1 | 9/2013 | Wilde et al. |
| 2013/0273543 A1 | 10/2013 | Gudmundsson et al. |
| 2013/0302808 A1 | 11/2013 | Vasmatzis |
| 2013/0302810 A1 | 11/2013 | Latham et al. |
| 2013/0303826 A1 | 11/2013 | Jurisica et al. |
| 2014/0030714 A1 | 1/2014 | Paschke et al. |
| 2014/0066323 A1 | 3/2014 | Buerki et al. |
| 2014/0080731 A1 | 3/2014 | Davicioni et al. |
| 2014/0087961 A1 | 3/2014 | Sulem et al. |
| 2014/0099261 A1 | 4/2014 | Keutgen et al. |
| 2014/0121126 A1 | 5/2014 | Bivona et al. |
| 2014/0143188 A1 | 5/2014 | Mackey et al. |
| 2014/0228237 A1 | 8/2014 | Kennedy et al. |
| 2014/0243240 A1 | 8/2014 | Soldin et al. |
| 2014/0302042 A1 | 10/2014 | Chin et al. |
| 2014/0315199 A1 | 10/2014 | Rhodes et al. |
| 2014/0315739 A1 | 10/2014 | Aharonov et al. |
| 2014/0349856 A1 | 11/2014 | Schnabel et al. |
| 2014/0349864 A1 | 11/2014 | Kennedy et al. |
| 2014/0371096 A1 | 12/2014 | Umbright et al. |
| 2015/0011401 A1 | 1/2015 | Davicioni et al. |
| 2015/0038376 A1 | 2/2015 | Tian et al. |
| 2015/0099665 A1 | 4/2015 | Rosenfeld et al. |
| 2015/0141470 A1 | 5/2015 | Garraway et al. |
| 2015/0030794 A1 | 10/2015 | Basu et al. |
| 2015/0275306 A1 | 10/2015 | Bernards et al. |
| 2015/0292030 A1* | 10/2015 | McConkey ...... G01N 33/57407 424/649 |
| 2015/0299808 A1 | 10/2015 | Gonzalez et al. |
| 2015/0329915 A1 | 11/2015 | Davicioni et al. |
| 2015/0368724 A1 | 12/2015 | Aharonov et al. |
| 2016/0024586 A1 | 1/2016 | Delfour et al. |
| 2016/0032395 A1 | 2/2016 | Davicioni et al. |
| 2016/0032400 A1 | 2/2016 | Gomis et al. |
| 2016/0068915 A1 | 3/2016 | Kennedy et al. |
| 2016/0076108 A1 | 3/2016 | Davicioni et al. |
| 2016/0115546 A1 | 4/2016 | Rosenfeld et al. |
| 2016/0120832 A1 | 5/2016 | Rabinowitz et al. |
| 2016/0251729 A1 | 9/2016 | Chinnaiyan et al. |
| 2016/0312305 A1 | 10/2016 | Kennedy et al. |
| 2016/0312306 A1 | 10/2016 | Kennedy et al. |
| 2016/0312307 A1 | 10/2016 | Kennedy et al. |
| 2016/0312308 A1 | 10/2016 | Kennedy et al. |
| 2016/0348184 A1 | 12/2016 | Chinnaiyan |
| 2017/0016076 A1 | 1/2017 | Barnett-Ltzhaki et al. |
| 2017/0145513 A1 | 5/2017 | Kennedy et al. |
| 2017/0166980 A1 | 6/2017 | Fahey, III et al. |
| 2017/0329894 A1 | 11/2017 | Kennedy et al. |
| 2018/0016642 A1 | 1/2018 | Kennedy et al. |
| 2018/0030540 A1 | 2/2018 | Davicioni et al. |
| 2018/0068058 A1 | 3/2018 | Abdueva et al. |
| 2018/0112275 A1 | 4/2018 | Davicioni et al. |
| 2018/0122508 A1 | 5/2018 | Wilde et al. |
| 2018/0127832 A1 | 5/2018 | Kennedy et al. |
| 2018/0291459 A1 | 10/2018 | Al-Deen Ashab et al. |
| 2019/0017123 A1 | 1/2019 | Davicioni et al. |
| 2019/0204322 A1 | 7/2019 | Alshalalfa et al. |
| 2019/0218621 A1 | 7/2019 | Davicioni |
| 2020/0165682 A1 | 5/2020 | Chinnaiyan et al. |
| 2020/0224276 A1 | 7/2020 | Chinnaiyan et al. |

FOREIGN PATENT DOCUMENTS

| | | |
|---|---|---|
| EP | 2 366 800 A1 | 9/2011 |
| WO | WO 1990/015070 A1 | 12/1990 |
| WO | WO 1992/010092 A1 | 6/1992 |
| WO | WO 1993/009668 A1 | 5/1993 |
| WO | WO 1993/022684 A1 | 11/1993 |
| WO | WO 1998/045420 A2 | 10/1998 |
| WO | WO 2001/060860 A2 | 8/2001 |
| WO | WO 2001/066753 A1 | 9/2001 |
| WO | WO 2002/000929 A1 | 1/2002 |
| WO | WO 2002/083921 A2 | 10/2002 |
| WO | WO 2003/012067 A2 | 2/2003 |
| WO | WO 2004/037972 A2 | 5/2004 |
| WO | WO 2005/040396 A2 | 5/2005 |
| WO | WO 2005/085471 A2 | 9/2005 |
| WO | WO 2005/100608 A2 | 10/2005 |
| WO | WO 2006/047484 A2 | 5/2006 |
| WO | WO 2006/091776 A2 | 8/2006 |
| WO | WO 2006/110264 A2 | 10/2006 |

(56) References Cited

FOREIGN PATENT DOCUMENTS

| WO | WO 2006/127537 A2 | 11/2006 |
|---|---|---|
| WO | WO 2006/135596 A2 | 12/2006 |
| WO | WO 2007/056049 A2 | 5/2007 |
| WO | WO 2007/070621 A2 | 6/2007 |
| WO | WO 07/081740 | 7/2007 |
| WO | WO 2007/081720 A2 | 7/2007 |
| WO | WO 2008/023087 A2 | 2/2008 |
| WO | WO 2008/046911 A2 | 4/2008 |
| WO | WO 2008/086478 A2 | 7/2008 |
| WO | WO 2008/112283 A2 | 9/2008 |
| WO | WO 2009/009432 A2 | 1/2009 |
| WO | WO 2009/020521 A2 | 2/2009 |
| WO | WO 2009/020905 A2 | 2/2009 |
| WO | WO 09/029266 | 3/2009 |
| WO | WO 2009/045115 A1 | 4/2009 |
| WO | WO 2009/074968 A2 | 6/2009 |
| WO | WO 2009/143603 A1 | 12/2009 |
| WO | WO 10/018601 | 2/2010 |
| WO | WO 2010/056374 A2 | 5/2010 |
| WO | WO 10/073248 | 7/2010 |
| WO | WO 2010/056374 A3 | 9/2010 |
| WO | WO 2010/099598 A1 | 9/2010 |
| WO | WO 10/123626 | 10/2010 |
| WO | WO 2010/124372 A1 | 11/2010 |
| WO | WO 2011/150453 A1 | 12/2011 |
| WO | WO 2012/031008 A2 | 3/2012 |
| WO | WO 2012/068383 A2 | 5/2012 |
| WO | WO 2012/135008 A1 | 10/2012 |
| WO | WO 13/006495 | 1/2013 |
| WO | WO 2013/088457 A1 | 6/2013 |
| WO | WO 2013/090620 A1 | 6/2013 |
| WO | WO 2013/116742 A1 | 8/2013 |
| WO | WO 2014/028884 A2 | 2/2014 |
| WO | WO 2014/043803 A1 | 3/2014 |
| WO | WO 14/085666 | 5/2014 |
| WO | WO 14/151764 | 9/2014 |
| WO | WO 15/073949 | 5/2015 |
| WO | WO 2015/071876 A2 | 5/2015 |
| WO | WO 16/141127 | 9/2016 |
| WO | WO 2017/059549 A1 | 4/2017 |
| WO | WO 2017/062505 A1 | 4/2017 |
| WO | WO 2018/165600 A1 | 9/2018 |
| WO | WO 19/023517 | 1/2019 |

OTHER PUBLICATIONS

Kardos et al. Claudin-low bladder tumors are immune infiltrated and actively immune suppressed. Published online Mar. 17, 2016. JCI Insight. vol. 1, No. 3, e85902, 17 pages. (Year: 2016).*

Seiler et al. Impact of Molecular Subtypes in Muscle-invasive Bladder Cancer on Predicting Response and Survival after Neoadjuvant Chemotherapy. 2017. European Urology. vol. 72, pp. 544-554. (Year: 2017).*

Abdueva et al., "Quantitative Expression Profiting in Formalin-Fixed Paraffin-Embedded Samples by Affymetrix Microarrays," Journal of Molecular Diagnostics (Jul. 2010) vol. 12, No. 4, pp. 409-417.

Affymetrix: Data Sheet, "GeneChip® Exon Array System for Human, Mouse, and Rat," Internet Citation, [Online] Jan. 25, 2012 [Retrieved from the Internet] lntp://www.biainformatics.atickland.aciaz/workshops/1O_March_2011 1Exon_EOST_Datash eet.pdf, 8 pages.

Agell et al., "A 12-Gene Expression Signature Is Associated with Aggressive Histological in Prostate Cancer: SEC14L1 and TCEB1 Genes Are Potential Markers of Progression," Am J Pathol (2012) vol. 181 (5), pp. 1585-1594.

Alberts et al., "Vesicular traffic in the secretory and endocytic pathways," Molecular Biology of the Cell (1994) 3rd Ed., p. 465.

Aldred et al., "Papillary and follicular thyroid carcinomas show distinctly different microarray expression profiles and can be distinguished by a minimum of five genes," J Clin Oncol. (2004) 22(17):3531-9.

Amling et al.: "Long-term hazard of progression after radical prostatectomy for clinically EB localized prostate cancer continued risk of biochemical failure after 5 years," J Urol. (2000) 164:101-105.

Amundadottir et al., "A common variant associated with prostate cancer in European and African populations," Nat Genet. (2006) 38:652-658.

Amundson et al., "Integrating global gene expression and radiation survival parameters across the 60 cell lines of the National Cancer Institute Anticancer Drug Screen," Cancer Research (2008) 68(2):415-424.

Ausubel, et al. Current Protocols in Molecular Biology. Wiley & Sons, New York (1995) Table of Contents.

Baetke et al., "Molecular Pathways Involved in Prostate Carcinogenesis: Insights from Public Microarray Datasets," PLoS One (2012) 7(11):e49831, 1-11.

Baggerly et al., "Deriving Chemosensitivity from Cell Lines: Forensic Bioinformatics and Reproducible Research in High-Throughput Biology," The Annals of Applied Sciences (2009) vol. 3, No. 4, pp. 1309-1334.

Ballman et al., "Faster cyclic loess: normalizing RNA arrays via linear models," Bioinformatics, 2004, 20 :2778-2786.

Bannert et al., "Retroelements and the human genome: new perspectives on an old relation." PNAS (Oct. 5, 2004) vol. 101, Suppl. 2, pp. 14572-14579.

Bauer et al., "Identification of Markers of Taxane Sensitivity Using Proteomic and Genomic Analyses of Breast Tumor from Patients Receiving Neoadjuvant Paclitaxel and Radiation," Clin. Cancer Res. (2010) 16(2):681-690, American Association for Cancer Research.

Benner et al., "Evolution, language and analogy in functional genomics," Trends in Genetics, (Jul. 2001) vol. 17, pp. 414-418.

Bergstralh et al., "Software for optimal matching in observation al studies," Epidemiology (1996) 7(3):331-332.

Best et al., "Molecular differentiation of high- and moderate-grade human prostate cancer by cDNA microarray analysis", Diagn Mol Pathol. (2003) 12(2):63-70.

Bibikova et al., "Gene expression profiles in formalin-fixed, paraffin-embedded tissues obtained with a novel assay for microarray analysis," Clin Chem., 2004, 50:2384-2386.

Bibikova et al., "Quantitative gene expression profiling in formalin-fixed, paraffin-embedded tissues using universal bead arrays," Am J Pathol. (2004) 165:1799-1807.

Bibikova et al., "Expression signatures that correlated with Gleason score and relapse in prostate cancer," Genomics (2007) 89(6):666-672.

Birney et al., "Identification and analysis of functional elements in 1% of the human genome by the ENCODE pilot project." Nature (Jun. 14, 2007); 447(7146):799-816.

Boorjian et al., "Long-term risk of clinical progression after biochemical recurrence following radical prostatectomy: the mpact of time from surgery to recurrence." Eur Urol. (Jun. 2011) 59(6):893-9.

Boormans et al., "Identification of TDRD1 as a direct target gene of ERG in primary prostate cancer," Int J Cancer (2013) vol. 133 (2), pp. 335-345.

Bostwick et al., "Prognostic factors in prostate cancer: College of American Pathologists consensus statement," Arch Pathol Lab Med (2000) 124(7):995-1000.

Bott et al., "Prostate cancer management: (2) an update on locally advanced and metastatic disease", Postgrad Med J, Dec. 3, 2003, 79(937), 643-645.

Brase et al., "TMPRSS2-ERG—specific transcriptional modulation is associated with prostate cancer biomarkers and TGF-β signaling," BMC Cancer (2011) 11(507):1-8.

Breiman, "Random Forests," Machine Learning (2001) 45:5-32.

Brouha et al., "Hot L1s account for the bulk of retrotransposition in the human population." PNAS USA (Apr. 29, 2003) 100(9):5280-5.

Bull et al., "Identification of potential diagnostic markers of prostate cancer and prostatic intraepithelial neoplasia using cDNA microarray," British J Cancer (Jun. 1, 2001) 84(11):1512-1519.

Bussemakers et al., "DD3: a new prostate-specific gene, highly overexpressed in prostate cancer." Cancer Res. (Dec. 1, 1999) 59(23):5975-9.

(56) References Cited

OTHER PUBLICATIONS

Carninci et al., "The transcriptional landscape of the mammalian genome," Science (Sep. 2, 2005) 09(5740):1559-63.
Cerutti et al. "Diagnosis of suspicious thyroid nodules using four protein biomarkers," Clin Cancer Res. (2006) 12(11 Pt 1):3311-8.
Chalitchagorn et al., "Distinctive pattern of LINE-1 methylation level in normal tissues and the association with carcinogenesis." Oncogene (Nov. 18, 2004) 23(54):8841-6.
Che et al.: "Prognostic Value of Abnormal p53 Expression in Locally Advanced Prostate Cancer Treated With Androgen Deprivation and Radiotherapy: A Study Based on RTOG 9202"; International Journal of Radiation: Oncology Biology Physics (Nov. 15, 2007) vol. 69, No. 4, pp. 1117-1123.
Chen et al., "Hepsin and maspin are inversely expressed in laser capture microdissectioned prostate cancer," J Urol. (Apr. 2003) 169(4):1316-1319.
Chen et al.: "Molecular determinants of resistance to antiandrogen therapy"; Nature Medicine, Nature Publishing Group, New York, NY (Jan. 1, 2004) vol. 10, No. 1, pp. 33-39.
Chen et al., "Significance of noninvasive diagnosis of prostate cancer with cytologic examination of prostatic fluid," J Nippon Med Sch. (Jun. 2006) 73(3):129-135.
Chen et al., "Deregulation of a Hox Protein Regulatory Network Spanning Prostate Cancer Initiation and Progression," Clin Cancer Res (Jun. 2012) 18(16):4291-4302.
Cheng et al. "Cell Proliferation in Prostate Cancer Patients with Lymph Node Metastasis", Clin Cancer Res (Oct. 1999) 5(10): 2820-2823.
Cheung et al., "Natural variation in human gene expression assessed in lymphoblastoid cells," Nature Genetics (2003) vol. 33, pp. 422-425.
Cheville et at., "Gene Panel Model Predictive of Outcome in Men at High-Risk of Systemic Progression and Death From Prostate Cancer After Radical Retropubic Prostatectomy," Journal Of Clinical Oncology (Aug. 20, 2008) vol. 26, No. 24.
Chifman et al., "Conservation of immune gene signatures in solid tumors and prognostic implications," BMC Cancer (2016) 16:911, pp. 1-17. DOI 10.1186/S12885-016-2948-Z.
Cho et al., "Hypermethylation of CpG island loci and hypomethylation of LINE-1 and Alu repeats in prostate denocarcinoma and their relationship to clinicopathological features", J Pathol (Feb. 2007) 211(3):269-77.
Chow et al., "LINE-1 activity in facultative heterochromatin formation during X chromosome inactivation," Cell (Jun. 11, 2010) 141(6):956-69.
Cibas, et al. "The Bethesda System for Reporting Thyroid Cytopathology," Am J Clin Pathol. (Nov. 2009) 132(5):658-65. doi: 10.1309/AJCPPHLWMI3JV4LA.
Clancy et al., "Profiling networks of distinct immune-cells in tumors," BMC Bioinformatics (2016) 17:263, pp. 1-15. DOI 10.1186/s12859-016-1141-3.
Clark-Langone et al. "Riornarker discovery for colon cancer using a 761 gene RT-PCR assay 2007," BMC Genomics (2007) 8:279 pp. 1-18.
Cologne et al., "Optimal Case-Control Matching in Practice," Epidemiology Resources Inc. (1995) 6(3):271-275.
Cooperberg et al., "The CAPRA-S score: A straightforward tool for improved prediction of outcomes after radical prostatectomy," Cancer (2011) vol. 117 (22), pp. 5039-5046.
Cordaux et al., "The impact of retrotransposons on human genome evolution." Nat Rev Genet. (Oct. 2009) 10(10):691-703.
Couzin-Frankel, Jennifer, "As Questions Grow, Duke Halts Trials, Launches Investigation," Science (Aug. 6, 2010) vol. 329, pp. 614-615.
Cuzik et al., "Prognostic value of an RNA expression signature derived from cell cycle proliferation genes in patients with prostate cancer: a restrospective study," thelancet.com/oncology (Mar. 2011) vol. 12, pp. 245-255.

Dahlman et al., "Effect of androgen deprivation therapy on the expression of prostate cancer biomarkets MSMB and MSMB-binding protein CRISP3," Prostate Cancer and Prostatic Diseases (2010) 13:369-375.
Dalela et al., "Contemporary Role of the Decipher Test in Prostate Cancer Management: Current Practice and Future Perspectives," Rev. Urol. (2016), 18(1):1-9, MedReviews®, LLC.
Dalsgaard Sorensen et al.: "Discovery of prostate cancer biomarkers by microarray gene expression profiling"; Expert Review of Molecular Diagnostics, vol. 10, No. 1, Jan. 1, 2010, pp. 49-64.
D'Amico et al., "Cancer-specific mortality after surgery or radiation for patients with clinically localized prostate cancer managed during the prostate-specific antigen era," J Clin Oncol. (2003) 21:2163-2172.
D'Amico et al., "Determinants of prostate cancer-specific survival after radiation therapy for patients with clinically localized prostate cancer," J Clin Oncol. (2002) 20:4567-4573.
Dawood, Shaheenah, "Novel Biomarkers of Metastatic Cancer," Expert Rev. Mo/. Diagn. (2010) 10(5):581-590, Expert Reviews Ltd.
Day et al., "Estimating enrichment of repetitive elements from high-throughput sequence data." Genome Biol. (2010) 11 (6):R69.
De Klein et al., "A cellular oncogene is translocated to the Philadelphia chromosome in chronic myelocytic leukaemia." Nature (Dec. 23, 1982) 300(5894):765-7.
De Marzo et al., "Pathological and molecular mechanisms of prostate carcinogenesis: implications for diagnosis, detection, prevention, and treatment," J Cell Biochem. (Feb. 15, 2004) 91(3):459-477.
Dechassa et al., "Architecture of the SWI/SNF-nucleosome complex," Mol Cell Biol. (Oct. 2008) vol. 28, No. 19, pp. 6010-6021.
Demichelis et al., "TMPRSS2:ERG gene fusion associated with lethal prostate cancer in a watchful waiting cohort," Oncogene (2007) 26:4596-4599.
Dhanasekaran et al., "Delineation of prognostic biomarkers in prostate cancer," Nature (2001) 412:822-826.
Dougherty, "The fundamental role of pattern recognition for gene-expression/microarray data in bioinformatics," Pattern recognition (2005) 38:2226-2228.
Eder et al., "Genes differentially expressed in prostate cancer," BJU Int. (May 2004) 93(8): 1151-1155.
Edwards et al., "Expression analysis onto microarrays of randomly selected cDNA clones highlights HOXB13 as a marker of human prostate cancer," Br J Cancer. (Jan. 31, 2005) 92(2):376-381.
Edwards et al.: "MicroRNAs and Ultraconserved Genes as Diagnostic Markers and Therapeutic Targets in Cancer and Cardiovascular Diseases", Journal of Cardiovascular Translational Research (May 5, 2010) vol. 3, No. 3, pp. 271-279.
Englisch, et al., "Chemically Modified Oligonucleotides as Probes and Inhibitors," Angew. Chern. Int. Ed. Eng. (1991) 30:613-629.
Ernst et al., "Decrease and gain of gene expression are equally discriminatory markers for prostate carcinoma: a gene expression analysis on total and microdissected prostate tissue," Am J Pathol. (Jun. 2002) 160(6):2169-2180.
Etzioni et al. "The case for early detection", Nature Reviews | Cancer (Apr. 2003) vol. 3, pp. 1-10.
Fan et al., "Concordance among gene- expression-based predictors for breast cancer," N Engl J Med. (2006) 355:560-569.
Feng et al., "Luminal and basal subtyping of prostate cancer," J Clin Oncol (Feb. 20, 2017) vol. 35, No. 6, p. 3, Abstract.
Feroze-Merzoug et al., "Molecular profiling in prostate cancer," Cancer Metastasis Rev. 1 (2001) 20(3-4):165-71.
Finley et al., "Discrimination of benign and malignant thyroid nodules by molecular profiling," Ann Surg. (2004) 240(3):425-36; discussion 436-7.
Finley et al., "Advancing the molecular diagnosis of thyroid nodules: defining benign lesions by molecular profiling," Thyroid (2005) 15(6):562-8.
Fodor et al., "Light-directed, spatially addressable parallel chemical synthesis," Science (Feb. 15, 1991) 251(4995):767-773.
Foley et al., "Molecular pathology of prostate cancer: the key to identifying new biomarkers of disease," Endocrine-Related Cancer (2004) 11:477-488.

(56) References Cited

OTHER PUBLICATIONS

Fontaine, et al., "Increasing the number of thyroid lesions classes in microarray analysis improves the relevance of diagnostic markers," PLoS One (Oct. 29, 2009) 4(10):e7632. doi: 10.1371/journal.pone. 0007632.
Fryknas et al., "Molecular markers for discrimination of benign and malignant follicular thyroid tumors," Tumour Biol. (2006) 27(4):211-20.
Fu et al., "Regulation of apoptosis by a prostate-specific and prostate cancer-associated noncoding gene, PCGEM1." DNA Cell Biol. (Mar. 2006) 25(3): 135-41.
Fujarewicz et al., "A multi-gene approach to differentiate papillary thyroid carcinoma from benign lesions: gene selection using support vector machines with bootstrapping," Endocr Relat Cancer (Sep. 2007) 14(3):809-26.
Gait. Chapter 16: Oligoribonucleotides. Antisense Research and Applications, Crookeand Lebleu Eds., CRC Press (1993) pp. 289-302.
Galamb et al., "Diagnostic mRNA Expression Patterns of Inflamed, Benign, and Malignant Colorectal Biopsy Specimen and their Correlation with Peripheral Blood Results," Cancer Epidemiology, Biomarkers & Prevention (Oct. 2008) 17(10):2835-2845.
Gao et al., "VISTA is an inhibitory immune checkpoint that is increased after ipilimumab therapy in patients with prostate cancer," Nat Med. (May 2017) 23(5):551-555.
Garber et al., "Diversity of gene expression in adenocarcinoma of the lung," PNAS (Nov. 20, 2001) vol. 98, No. 24, pp. 13784-13789.
Genevieve de Saint Basile et al., "Severe Combined Immunodeficiency Caused By Deficiency In Either The Ii Or the E Subunit Of CD3," Journal of Clinical Investigation (2004) vol. 114, No. 10. p. 1512-1517.
Gibb et al., "The functional role of long non-coding RNA in human carcinomas", Molecular Cancer, Biomed Central, London, GB (Apr. 13, 2011) vol. 10, No. 1, p. 38.
Giordano et al., "Organ-Specific Molecular Classification of Primary Lung, Colon, and Ovarian Adenocarcinomas Using Gene Expression Profiles," Am J Pathol (2001) 159(4):1231-1238.
Gleave et al., "Randomized comparative study of 3 versus 8-month neoadjuvant hormonal therapy before radical orostatectomy : biochemical and pathological effects," J Urol. (2001) 166:500-507.
Glinsky et al., "Gene expression profiling predicts clinical outcome of prostate cancer," J Clin Investigation (2004) 113(6):913-923.
Glinsky et al., "Microarray analysis identifies a death-from-cancer signature predicting therapy i failure in patients with multiple types of cancer," J Clin Invest. (2005) 115: 1503-1521.
Gonzalgo et al: "Molecular pathways to prostate cancer"; J Urol. (2003) 170(6 Pt 1):2444-2452.
Greenbaum et al.: "Comparing protein abundance and mRNA expression levels on a genomic scale"; Genome Biology (2003) 4(9):117.1-117.8.
Griffith et al., "Meta-analysis and meta-review of thyroid cancer gene expression profiling studies identifies important diagnostic biomarkers," J Clin Oncol. (2006) 24(31):5043-51.
Griffith, et al. Biomarker panel diagnosis of thyroid cancer: a critical review. Expert Rev Anticancer Ther. (Sep. 2008) 8(9):1399-413. doi: 10.1586/14737140.8.9.1399.
Gupta et al., "Long non-coding RNA HOTAIR reprograms chromatin state to promote cancer metastasis," Nature (Apr. 15, 2010) 464(7291): 1071-6.
Guttman et al., "Chromatin signature reveals over a thousand highly conserved large non-coding RNAs in mammals", Nature (Mar. 12, 2009) 458(7235):223-7.
Guttman et al., "Ab initio reconstruction of transcriptomes of pluripotent and lineage committed cells reveals gene structures of thousands of lincRNAs," Nat Biotechnol. (May 2010) 28(5):503-10.
Haiman et al.: "Multiple regions within 8q24 independently affect risk for prostate cancer"; Nat Genet. (2007) 39:638-644.

Hamada et al., "Diagnostic usefulness of PCR profiling of the differentially expressed marker genes in thyroid papillary carcinomas," Cancer Lett. (Jun. 28, 2005) 224(2):289-301. Epub Nov. 18, 2004.
He et al., "The antisense transcriptomes of human cells", Science (Dec. 19, 2008) 322(5909): 1855-7.
Heemers, H. V. et al.: "Identification of a Clinically Relevant Androgen-Dependent Gene Signature in Prostate Cancer"; Cancer Research, vol. 71, No. 5 (2011) pp. 1978-1988.
Heidenreich et al., "EAU Guidelines on Prostate Cancer. Part 1: Screening, Diagnosis, and Treatment of Clinically Localised Disease," European Urology (2011) vol. 59, pp. 61-71.
Henrotin et al.: "Type II collagen peptides for measuring cartilage degradation," Biotheology (2004) 41 (3-4): Abstract.
Henshall et al., "Survival Analysis of Genome-Wide Gene Expression Profiles of Prostate ancers Identifies New Prognostic Targets of Disease Relapse," Cancer Research (Jul. 15, 2003) 63, 14196-4203.
Holzbeierlein et al., "Gene expression analysis of human prostate carcinoma during hormonal therapy identifies androgen-responsive genes and mechanisms of therapy resistance," Am. J . Pathol. (Jan. 2004) 164(1):217-227.
Hornberger et al., "A Multigene Prognostic Assay for Selection of Adjuvant Chemotherapy in Patients with T3, Stage II Colon Cancer: Impact on Quality-Adjusted Life Expectancy and Costs," Value In Health 15 (2012) pp. 1014-1021.
Huarte et al., "Large non-coding RNAs: missing links in cancer?" Human Molecular Genetics (Oct. 15, 2010) 19(2): R152-R161.
Hughes et al., "Molecular pathology of prostate cancer," J Clin Pathol. (Jul. 2005) 58(7):673-684.
Hughes et al., "Topoisomerase II—a expression increases with increasing Gleason score and with hormone insensitivity in prostate carcinoma," J Clin Pathol. (Jul. 2006) 59(7): 721-724.
Ida et al., "Topoisomerase II alpha protein expression Is predictive of outcome in Gleason score 7 prostate cancer patients treated surgically and is dependent on ERG status." Mod Pathol. (Feb. 2010) Abstract 1895, 23 : 424A-425A.
Ito et al., "Linkage of elevated ets-2 expression to hepatocarcinogenesis," Anticancer Research (2002) 22(4):2385-2389.
Jemal et al.: "Cancer statistics," CA Cancer J Clin. (2005) 55:10-30.
Jenkins et al., "Prognostic significance of ailetic imbalance of chromosome arms 71, 8p, 16q, and 18q in stage T3NOMO prostate cancer," Genes, Chromosomes & Cancer (1998) 21:131-143.
Jhavar et al., "Integration of ERG gene mapping and gene-expression profiling identifies distinct categories of human prostate cancer," BJUI (2008) vol. 103 (9), pp. 1256-1269.
Jhavar et al., "Technical Advance: Detection of TMPRSS2-ERG Translocations in Human Prostate Cancer by Expression Profiling Using GeneChip Human Exon 1.0 ST Arrays," J Mol. Diag (Jan. 2008) vol. 10, No. 1, pp. 50-57.
Jones et al., "Frequent mutations of chromatin remodeling gene ARID1A in ovarian clear cell carcinoma" Science (Oct. 8, 2010) 330(6001):228-31.
Kanehisa, "Use of statistical criteria for screening potential homologies in nucleic acid sequences," Nucleic Acids Res. (Jan. 11, 1984) 12(1 Pt 1):203-13.
Karan et al., "Current status of the molecular genetics of human prostatic adenocarcinomas," Int J Cancer, 2003, 103(3):285-293.
Karayi et al., "Molecular biology of prostate cancer," Prostate Cancer Prostatic Dis. (2004) 7(1):6-20.
Karnes et al., "Radical prostatectomy for high-risk prostate cancer," Jpn. J. Clin. Oneal. (Oct. 19, 2009) 40 (1): 3-9, Epub.
Karnes et al., "The ability of biomarkers to predict systemic progression in men with high-risk prostate cancer treated surgically is dependent on ERG status," Cancer Res. (Nov. 9, 2010) 70(22):8994-9002, Epub.
Kasraeian, et al., "A comparison of fine-needle aspiration, core biopsy, and surgical biopsy in the diagnosis of extremity soft tissue masses," Clin Orthop Relat Res. (Nov. 2010) 468(11):2992-3002.
Kawamorita et al., "Radical prostatectomy for high-risk prostate cancer: Biochemical outcome," International Journal of Urology (2009) 16:733-738.
Kebebew et al., "Diagnostic and extent of disease multigene assay for malignant thyroid neoplasms," Cancer (2006) 106(12):2592-7.

(56) References Cited

OTHER PUBLICATIONS

Kestin, "Potential survival advantage with early androgen deprivation for biochemical failure after external beam radiotherapy: the importance of accurately defining biochemical disease status," Int J Rad Oncol Biol Phys. (2004) 60:453-62.
Khor et al.: "Bcl-2 and Bax Expression Predict Prostate Cancer Outcome in Men Treated with Androgen Deprivation and Radiotherapy on Radiation Therapy Oncology Group Protocol 92-02"; Clinical Cancer Research (Jun. 15, 2007) vol. 13, No. 12, pp. 3585-3590.
Kiessling, et al., "D-TMPP: A novel androgen-regulated gene preferentially expressed in prostate and prostate cancer that is the first characterized member of an eukaryotic gene family," The Prostate (2005) 64:387-400.
Kikuchi et al., "Expression profiles of non-small cell lung cancers on cDNA microarrays: identification of genes for prediction of lymph-node metastasis and sensitivity to anti-cancer drugs," Oncogene (2003) 22, pp. 2192-2205.
Kishi et al., "Expression of the survivin gene in prostate cancer: correlation with clinicopathological characteristics, proliferative activity and apoptosis," J Urol. (May 2004) 171(5): 1855-1860.
Klee et al., "Candidate Serum Biomarkers for Prostate Adenocarcinoma identified by mRNA Differences in Prostate Tissue and Verified with Protein Measurements in Tissue and Blood," Clinical Chemistry (2012) 58(3):599-609.
Kosari et al., "Identification of biomarkers for prostate cancer," Clin. Cancer Res. (2008) 1734-1743.
Koshkin et al., "LNA (locked nucleic acids): An RNA mimic forming exceedingly stable LNA," LNA duplexes. J Am Chem Soc (1998) 120:13252-13253.
Koshkin et al., "LNA (locked nucleic acids): synthesis of the adenine, cytosine, guanine 5-methylcytosine, thymine and uracil bicyclonucleoside monomers, oligomerisation, and unprecedented nucleic acid recognition," Tetrahedron (1998) 54(14):3607-3630.
Kroschwitz The Concise Encyclopedia Of Polymer Science And Engineering (1990) (pp. 858-859).
Kube et al., "Optimization of laser capture microdissection and RNA amplification for gene expression profiling of prostate cancer," BMC Mol. Biol. (2007) 8:25.
Kumar, et al., "The first analogues of LNA (locked nucleic acids): phosphorothioate-LNA and 2'-thio-LNA," Bioorg Med Chem Lett. (Aug. 18, 1998) 8(16):2219-22.
Kumar-Sinha et al., "Molecular markers to identify patients al risk for recurrence after primary treatment for prostate cancer," Urology, 62 Suppl 1:19-35, Dec. 29, 2003.
Kunarso et al., "Transposable elements have rewired the core regulatory network of human embryonic stem cells," Nat Genet (Jul. 2010) 42(7):631-4.
Landers et al.: "Use of multiple biomarkers for a molecular diagnosis of prostate cancer"; Int. J. Cancer (May 10, 2005) 114 pp. 950-956.
Lapointe et al., "Gene expression profiling identifies clinically relevant subtypes of prostate cancer," PNAS USA (2004) 101:811-816.
Latulippe et al., "Comprehensive Gene Expression Analysis of Prostate Cancer Reveals Distinct Transcriptional Programs Associated with Metastatic Disease," Cancer Res. (2002) 62:4499-4506.
Lawton et al., "Updated results of the phase III Radiation Therapy Oncology Group (RTOG) trial 85-31 evaluating the potential benefit of androgen suppression following standard radiation therapy for unfavorable prognosis carcinoma of the prostate," Int J Rad Oncol Biol Phvs. (2001) 49:937-946.
Leyten et al., "Identification of a Candidate Gene Panel for the Early Diagnosis of Prostate Cancer," Clinical Cancer Research (2015) 21(13):3061-3070.
Lin et al., "Cox Regression with Incomplete Covariate Measurements," Journal of the American Statistical Association (1993) vol. 88 (424), pp. 1341-1349.
Liong et al., "Blood-Based Biomarkers of Aggressive Prostate Cancer," PLoS One (Sep. 2012) vol. 7, Issue 7, e45802, pp. 1-7.

Livingston et al., "*Homo sapiens* CDC20 Cell Division Cycle 20 Homolog (CDC20)," Gene (Apr. 24, 2006).
Lockstone, "Exon array data analysis using Affymetrix power tools and R statistical software," Briefings in bioinformatics (2011) vol. 12 (6), pp. 634-644.
Lunardi et al., "A co-clinical approach identified mechanisms and potential therapies for androgen deprivation resistance in prostate cancer," Nature Genetics (Jul. 2013) vol. 45, No. 7, pp. 747-757.
Luo et al., "Human Prostate Cancer and Benign Prostatic Hyperplasia : Molecular Dissection by Gene Expression Profiling," Cancer Res. (2001) 61:4683-4688.
Luo et al., "Gene expression analysis of prostate cancers," Molecular Carcinogenesis (Jan. 2002) 33(1):25-35.
Magee et al., "Expression Profiling Reveals Hepsin Overexpression in Prostate Cancer," Cancer Res. (2001) 61:5692-5696.
Martens-Uzunova, E. S. et al.: "Diagnostic and prognostic signatures from the small non-coding RNA transcriptome in prostate cancer", Oncogene (Jul. 18, 2011) vol. 31, No. 8, pp. 978-991.
Martin, "A New Access to 2'-O-Alkylated Ribonucleosides and Properties of 2'-O-Alkylated Oligoribonucleotides," Helv. Chim. Acta. (1995) 78:486-504. (in German with English abstract).
Mazzanti, et al., "Using gene expression profiling to differentiate benign versus malignant thyroid tumors," Cancer Res. (Apr. 15, 2004) 64(8):2898-903.
McCall et al., "Frozen robust multiarray analysis (fRMA)", Biostatistics (2010) vol. 11 (2), 242-253.
Mercer, DW, "Use of multiple markers to enhance clinical utility", Immunol Ser. (1990) 53: 39-54.
Mineva et al., "Differential expression of alphaB-crystallin and Hsp27-1 in anaplastic thyroid carcinomas because of tumor-specific alphaB-crystallin gene (CRYAB) silencing," Cell Stress Chaperones (Autumn 2005) 10(3):171-84.
Mitelman, "Recurrent chromosome aberrations in cancer," Mutation Research (2000) 462: 247-253.
Montironi et al., "Carcinoma of the prostate: inherited susceptibility, somatic gene defects and androgen receptors," Virchows Arch. (Jun. 2004) 444(6):503-508.
Moul, "Prostate specific antigen only progression of prostate cancer," J Urol. (2000) 163:1632-42.
Moul et al., "Early versus delayed hormonal therapy for prostate specific antigen only recurrence of prostate cancer after radical prostatectomy," J Urol. (2004) 171:1141-1147.
Mühlenbruch et al., "Multiple imputation was a valid approach to estimate absolute risk from a prediction model based on case—cohort data," Journal of Clinical Epidemiology (2017) 84:130-141.
Nakagawa et al., "A Tissue Biomarker Panel Predicting Systemic Progression after PSA Recurrence Post-Definitive Prostate Cancer Therapy," PLos One (2008) 3(5):e2318, 14 pages.
Newson, Roger, "Confidence intervals for rank statistics: Somers' D and extensions," The Stata Journal (Sep. 2006) 6(3):309-334.
Nielsen et al., "Sequence-selective recognition of DNA by strand displacement with a thymine-substituted polyamide," Science (1991) 254: 1497-1500.
Noordzij et al. "The prognostic value of CD44 isoforms in prostate cancer patients treated by radical prostatectomy", Clin Cancer Res (May 1997) 3(5): 805-815.
Norman, James, "Thyroid Nodule Ultrasound", Endocrine website (Updated Oct. 13, 2010) http://www.endocrineweb.com/noduleus.html.
Ohl et al., "Gene expression studies in prostate cancer tissue: which reference gene should be selected for normalization?," J. Mol. Med . (2005) 83(12):1014-1024.
Ong et al., "Expression Profiling Identifies a Novel-Methylacyl-CoA Racemase Exon with Fumarate Hydratase Homology," Cancer Research (Jun. 15, 2003) 63:3296-3301.
Oosumi et al., "Mariner transposons in humans", Nature (Dec. 14, 1995) 378 (6558): 672.
Parker et al., "High expression levels of surviving protein independently predict a poor outcome for patients who undergo surgery for clear cell renal cell carcinoma," Cancer (2006) 107:37-45.
Pascal et al., "Correlation of mRNA and protein levels: Cell type-specific gene expression of cluster designation antigens in the prostate," BMC Genomics (2008) 9:246 (13 pages).

(56) References Cited

OTHER PUBLICATIONS

Patel et al., "Preoperative PSA velocity is an independent prognostic factor for relapse after radical prostatectomy," J Clin Oncol. (2005) 23:6157-6162.
Paulo et al., "Molecular Subtyping of Primary Prostate Cancer Reveals Specific and Shared Target Genes of Different ETS Rearrangements," Neoplasia (Jul. 2012) 14(7):600-611.
Penney et al., "mRNA Expression Signature of Gleason Grade Predicts Lethal Prostate Cancer," J Clin Oncol (Jun. 10, 2011) vol. 29, No. 17, pp. 2391-2396.
Penney et al., "Appendix (online only) of Penney et al., J Clin Oncol 29:2391 (Jun. 2011; online May 2, 2011)" pp. 1-9.
Pereira et al., "Coagulation factor V and VIIIN ratio as predictors of outcome in paracetamol induced fulminant hepatic failure: relation to other prognostic indicators," Gut (1992) 33:98-102.
Perez et al., "Long, abundantly expressed non-coding transcripts are altered in cancer," Human Molecular Genetics (2008) vol. 17, No. 5, pp. 642-655. Published online Nov. 15, 207.
Pienta et al. "The current state of preclinical prostate cancer animal models"; Prostate (2008) 69: 629-639.
Pilepich et al., "Phase III radiation therapy oncology group (RTOG) trial 86-10 of androgen deprivation adjuvant to definitive radiotherapy in locally advanced carcinoma of the prostate," Int. J. Radiation Oncology Biol. Phys. (2001) vol. 50, No. 5, pp. 1243-1252.
Pinover et al., "Validation of a treatment policy for patients with prostate specific antigen failure after three-dimensional conformal prostate radiation therapy," Cancer (Feb. 15, 2003) vol. 97, No. 4, pp. 1127-1133.
Pittoni et al., "The Dark Side of Mast Cell-Targeted Therapy in Prostate Cancer," Cancer Res. (2012) 72(4):831-835.
Porkka et al: Molecular mechanisms of prostate cancer; Eur Urol. (2004) 45(6):683-691.
Porkka et al., "RAD21 and KIAA0196 at 8q24 are amplified and overexpressed in prostate cancer," Genes Chromosomes Cancer (2007) 39:1-10.
Pound et al., "Natural history of progression after PSA elevation following radical prostatectomy," JAMA (1999) 281:1591-1597.
Prasad et al., "Identification of genes differentially expressed in benign versus malignant thyroid tumors," Clin Cancer Res. (2008) 14(11):3327-37.
Prensner et al., "Transcriptome Sequencing Identifies PCAT-1, a Novel lincRNA Implicated in Prostate Cancer Progression," (2012) 29 (8): 742-749.
Puskas, et al., "Gene profiling identifies genes specific for well-differentiated epithelial thyroid tumors," Cell Mol Biol (Noisy-le-grand) (Sep. 5, 2005) 51(2):177-86.
Rabbits, "Chromosomal translocations in human cancer", Nature (Nov. 10, 1994) 372: 143-149.
Reis et al., "Antisense intronic non-coding RNA levels correlate to the degree of tumor differentiation in prostate cancer," Oncogene (2004) 23(39):6684-6692.
Rhodes et al., "Multiplex biomarker approach for determining risk of prostatespecific antigen-defined recurrence of prostate cancer," J Nat Cancer Inst. (May 7, 2003) vol. 95, No. 9, pp. 661-668.
Rhodes et al., "Oncomine: A Cancer Microarray Database and Integrated Data-Mining Platform," Neoplasia (2004) 6:1-6.
Rhodes et al., "Large-scale meta-analysis of cancer microarray data identifies common transcriptional profiles of neoplastic transformation and progression," Proc Nat Acad Sci USA (2004) 101:9309-9314.
Rinn et al., "Functional demarcation of active and silent chromatin domains in human HOX loci by noncoding RNAs," Cell (Jun. 29, 2007) 129(7):1311-23.
Roberts et al., "The SWI/SNF complex-chromatin and cancer." Nat Rev Cancer (Feb. 2004) 4(2):133-42.
Robertson et al., "DNA in radical prostatectomy specimens. Prognostic value of tumor ploidy," Acta Oncologica (1991) 30(2):205-207.

Robertson et al., "Reconstructing the ancient mariners of humans." Nat Genet. (Apr. 1996) 12(4):360-1.
Robinson, et al., "A comparison of Affymetrix gene expression arrays," BMC Bioinformatics (Nov. 15, 2007) 8:449.
Robinson et al., "A dynamic programming approach for the alignment of signal peaks in multiple gas chromatography-mass spectrometry experiments," BMC Bioinformatics (2007) 8.1:419.
Romanuik et al., "LNCaP Atlas: Gene expression associated with in vivo progression to castration-recurrent prostate cancer," GMB Medical Genomics (2010) 3:43, pp. 1-19.
Ross et al., "Tissue-based Genomics Augments Post-prostatectomy Risk Stratification in a Natural History Cohort of Intermediate- and High-Risk Men," European Urology 69 (2016) pp. 157-165.
Rotblat et al., "A Possible Role for Long Non-Coding RNA in Modulating Signaling Pathways," Med. Hvnotheses (2011) 77:962-965, Elsevier.
Rotunno et al., "A Gene Expression Signature from Peripheral Whole Blood for Stage I Lung Adenocarcinoma," Cancer Prevention Research (Jul. 8, 2011) 4(10) 1599-1607.
Rowley, "A new Consistent Chromosomal Abnormal ity in Chronic Myelogenous Leukaemia Identified by Quinacrine rluorescence and Giemsa Staining," Nature (Jun. 1, 1973) 243:290-293.
Rowley, "Chromosome translocations: dangerous liaisons revisited," Nature Reviews: Cancer (Dec. 2001) 1):245-250.
Rubin et al., "Molecular genetics of human prostate cancer," Modern Pathol. (2004) 17(3):380-388.
Saito-Hisaminato et al., "Genome-Wide Profiling of Gene Expression in 29 Normal Human Tissues with a cDNA Microarray," DNA Research (2002) vol. 9, pp. 35-45.
Saligan et al., "Supervised Classification by Filter Methods and Recursive Feature Elimination Predicts Rick of Radiotherapy-Related Fatigue in Patients with Prosate Cancer," Cancer Informatics (2014) 13: 141-152.
Sandler et al., "Overall survival after prostate-specific-antigen-detected recurrence following conformal radiation therapy," Int J Rad Oncol Biol Phvs. (2000) 48:629-633.
Sanghvi, "Heterocyclic base modifications in nucleic acids and their applications in antisense oligonucleotides in Antisense Research and Applications," Crooke, S. T. and Lebleu, B., ed., CRC Press. (1993) Ch 15 274-285.
Saramaki et al., "Amplification of EIF3S3 gene is associated with advanced stage in prostate cancer," Am J Pathol. (2001) 159:2089-2094.
Sato et al., "Clinical significance of alterations of chromosome 8 in high-grade, advanced, nonmetastatic prostate carcinoma," J Natl Cancer Inst. (1999) 91:1574-1580.
Savinainen et al., "Expression and copy number analysis of TRPS 1, EIF3S3 and MYC genes in breast and prostate cancer," Br J Cancer (2004) 90: 1041-1046.
Savinainen et al., "Over expression of EIF3S3 promotes cancer cell growth," The Prostate (2006) 66: 1144-1150.
Schmidt et al., "Lack of interferon consensus sequence binding protein (ICSBP) transcripts in human myeloid leukemias," Blood (1998) 91:22-29.
Schumacher et al., "A Common 8q24 Variant in Prostate and Breast Cancer from a Large Nested Case-Control Study," Cancer Res. (2007) 67:2951-2956.
Severi et al., "The Common Variant rs1447295 on Chromosome 8q24 and Prostate Cancer Risk: Results from an Australian Population-based Case-Control Study", Cancer Epidemiology, Biomarkers & Prevention (2007) 16:610-611.
Shariat et al., "Survivin expression is associated with features of biologically aggressive prostate carcinoma," Cancer (2004) 100(4): 751-757.
Shariat et al., "An updated catalog of prostate cancer predictive tools," Cancer (2008) 113(11):3062-6.
Shen et al., "The SWI/SNF ATPase Brm is a gatekeeper of proliferative control in prostate cancer," Cancer Res. (Dec. 15, 2008) 68(24):10154-62.
Shibru et al., "Does the 3-gene diagnostic assay accurately distinguish benign from malignant thyroid neoplasms?" Cancer (Sep. 1, 2008) 113(5):930-5. doi: 10.1002/cncr.23703.

(56) References Cited

OTHER PUBLICATIONS

Shipley et al., "Radiation therapy for clinically localized prostate cancer: a multi-institutional pooled analysis," JAMA (1999) 281:1598-1604.
Simmons et al., "Natural history of biochemical recurrence after radical prostatectomy: risk assessment for secondary herapy," Eur Urol. (May 2007) 51(5):1175-84.
Singh et al., "Synthesis of 2'-amino-LNA: A novel conformationally restricted high-affinity oligonucleotide analogues with a handle," J Org Chem (1998) 63:10035-10039.
Singh et al., "LNA (locked nucleic acids): synthesis and high-affinity nucleic acid recognition," Chem Common (1998) 4:455-456.
Singh et al., "Gene expression correlates of clinical prostate cancer behavior," Cancer Cell (Mar. 2002) vol. 1, pp. 1203-1209.
Slotkin et al., "Transposable elements and the epigenetic regulation of the genome." Nat Rev Genet. (Apr. 2007) 8(4):272-85.
Srikantan et al., "PCGEM1, a prostate-specific gene, is overexpressed in prostate cancer," PNAS (Oct. 24, 2000) 97(22): 12216-12221.
Stamey et al., "Molecular genetic profiling of Gleason grade 415 prostate cancers compared to benign prostatichyperplasia," J Urol. (2001) 166(6):2171-2177.
Stanbrough et al., "Increased Expression of Genes Converting Adrenal Androgens to Testosterone in Androgen-Independent Prostate Cancer," Cancer Res (Mar. 1, 2006) 66(5):2815-2825.
Stavenhagen et al., "An ancient provirus has imposed androgen regulation on the adjacent mouse sex-limited protein Jene." Cell (Oct. 21, 1988) 55(2):247-54.
Stephenson et al., "Integration of gene expression profiling and clinical variables to predict prostate carcinoma recurrence after radical prostatectomy," Cancer (Jul. 15, 2005) 104(2):290-298.
Subramanian et al., "Gene set enrichment analysis: A knowledge-based approach for interpreting genome-wide expression profiles," PNAS USA (2005) 102:15545-15550.
Sun et al., "Aberrant expression of SWI/SNF catalytic subunits BRG1/BRM is associated with tumor development and ncreased invasiveness in prostate cancers," Prostate (Feb. 1, 2007) 67(2):203-13.
Taft et al., "Non-coding RNAs: regulators of disease," J Pathol. (Jan. 2010) 220(2):126-39.
Takayama et al., "TACC2 Is an Androgen-Responsive Cell Cycle Regulator Promoting Androgen-Mediatged and Castration-Resistant Growth of Prostate Cancer," Mol Endocrinol (May 2012) 26(5):748-761.
Taylor et al., "Integrative genomic profiling of human prostate cancer," Cancer Cell (Jul. 13, 2010) vol. 18 (1), pp. 11-22.
Thompson et al., "Adjuvant and Salvage Radiotherapy After Prostatectomy: AUA/ASTRO Guideline," J Urol. (2013) 190(2):441-449.
Thorsen et al., "Alternative Splicing in Colon, Bladder, and Prostate Cancer Identified by Exon Array Analysis," Molecular & Cellular Proteomics (Mar. 18, 2008) vol. 7, No. 7, pp. 1214-1224.
Tockman et al., "Considerations in bringing a cancer biomarker to clinical application," Cancer Research (1992) 52:2711-2718.
Tollefson et al., "Stratification of Patient Risk Based on Prostate-Specific Antigen Doubling Time After Radical Retropubic Prostatectomy," Mayo Clin Proc. (2007) 82:422-427.
Tomlins et al., "Recurrent Fusion of TMPRSS2 and ETS Transcription Factor Genes in Prostate Cancer," Science (2005) 310(5748):644-648.
Tomlins et al., "TMPRSS2:ETV4 Gene Fusions Define a Third Molecular Subtype of Prostate Cancer," Cancer Res. (2006) 66:3396-3400.
Tomlins et al., "Distinct classes of chromosomal rearrangements create oncogenic ETS gene fusions in prostate cancer," Nature (Aug. 2, 2007) 448(7153):595-9.
Tomlins et al., "Integrative molecular concept modeling of prostate cancer progression," Nat Genet. (2007) 39:41-51.
Tricoli et al., "Detection of prostate cancer and predicting progression: current and future diagnostic markers," Clinical Cancer Research (Jun. 15, 2004) 10:3943-3953.
True et al., "A molecular correlate to the Gleason grading system for prostate adenocarcinoma," PNAS (Jul. 18, 2006) vol. 103, No. 29, pp. 10991-10996.
Tsuchiya et al., "Clinical significance in situ hybridization analysis in pathologic of alterations of chromosome 8 detected by fluorescence organ-confined prostate cancer," Genes Chromosomes Cancer (2002) 34:363-371.
Tsuchiya et al., "Mapping and gene expression profile of the minimally overrepresented 8q24 region in prostate cancer," Am J Pathol. (May 2002) 160(5):1799-1806.
Vanaja et al., "Transcriptional Silencing of Zinc Finger Protein 185 Identified Profiling Is Associated with Prostate Cancer Progression," Cancer Research (Jul. 15, 2003) 63:3877-3882.
Vanaja et al., "PDLIM4 Represseion by Hypermethylation as a Potential Biomarker for Prostate Cancer," Clin. Cancer Res. (2006) 12(4):1128-1136.
Varambally et al., "Integrative Genomic and Proteomic Analysis of Prostate Cancer Reveals Signatures of Metastatic Progression," Cancer Cell (Nov. 2005) 8(5):393-406.
Varela et al., "Exome sequencing identifies frequent mutation of the SWI/SNF complex gene PBRM1 in renal carcinoma," Nature (Jan. 27, 2011) 469(7331):539-42.
Varricchi et al., "Are Mast Cells MASTers in Cancer?" Front Immunol. ePub (Apr. 12, 2017) 8:424.
Versteege et al., "Truncating mutations of hSNF5/INI1 in aggressive paediatric cancer." Nature (Jul. 9, 1998) 394 6689):203-6.
Vickers et al., "Extensions to decision curve analysis, a novel method for evaluating diagnostic tests, prediction models and molecular markers," BMC Medical Informatics and Decision Making, (2008) 8(53):1-17.
Visakorpi, "The molecular genetics of prostate cancer," Urology (2003) 62(5 Suppl 1):3-10.
Wang et al., "Two common chromosome 8q24 variants are associated with increased risk for prostate cancer," Cancer Res. (2007) 67:2944-2950.
Wang et al., "RNA-Seq: a revolutionary tool for transcriptomics," Nature Reviews/Genetics (Jan. 2009) vol. 10, pp. 57-63.
Watson et al., "Future opportunities for the diagnosis and treatment of prostate cancer," Prostate Cancer Prostatic Dis. (2004) 7:S8-S13.
Weber et al., "The prognostic value of expression of HIF1[alpha], EGFR and VEGF-A, in localized prostate cancer for intermediate- and high-risk patients treated with radiation therapy with or without androgen deprivation therapy," Radiation Oncology (Apr. 30, 2012) vol. 7, No. 66, 8 pages.
Welsh et al., "Analysis of Gene Expression Identifies Candidate Markers and Pharmacological Targets in Prostate Cancer," Cancer Res. (Aug. 15, 2001) 61:5974-5978.
Wiegand et al., "ARID1A mutations in endometriosis-associated ovarian carcinomas," N Engl J Med. (Oct. 14, 2010) 363 (16):1532-43.
Willman et al., "Immunohistochemical staining for DNA topoisomerase II-alpha in benign, premalignant, and malignant lesions of the prostate," Prostate (Mar. 1, 2000) 42(4):280-286.
Winkler et al.: "Stage D1 prostatic adenocarcinoma: significance of nuclear DNA ploidy patterns studied by flow cytometry," Mayo Clin Proc. (1988) 63(2): 103-112.
Wyatt et al., "Heterogeneity in the inter-tumor transcriptome of high risk prostate cancer," Genome Biology (Aug. 26, 2014) vol. 15, No. 8, pp. 2-14.
Yap et al., "Molecular interplay of the noncoding RNA ANRIL and methylated histone H3 lysine 27 by polycomb CBX7 n transcriptional silencing of INK4a," Mol Cell. (Jun. 11, 2010) 38(5):662-74.
Yates et al., "X:Map: annotation and visualization of genome structure for Affymetrix exon array analysis," Nucleic Acids Res. (2008) vol. 36:D780-D786.
Yeager et al., "Genome-wide association study of prostate cancer identifies a second risk locus at 8q24," Nat Genet (2007) 39:645-649.

(56) References Cited

OTHER PUBLICATIONS

Yegnasubramanian et al., "DNA hypomethylation arises later in prostate cancer progression than CpG island hypermethylation and contributes to metastatic tumor heterogeneity," Cancer Res. (Nov. 1, 2008) 68(21): pp. 8954-8967.
Yeliin et al., "Widespread occurrence of antisense transcription in the human genome," Nat Biotechnol. (2003) 21(4):379-86.
Yu et al., "Gene expression alterations in prostate cancer predicting tumor aggression and preceding development of malignancy," J Clin Oncol. (Jul. 15, 2004) 22(14):2790-2799.
Yu et al., "An integrated network of androgen receptor, polycomb, and TMPRSS2-ERG gene fusions in prostate cancer progression," Cancer Cell. (May 18, 2010) 17(5):443-54.
Yukinawa et al., "A multi-class predictor based on a probabilistic model: application to gene expression profiling-based diagnosis of thyroid tumors," BMC Genomics (Jul. 27, 2006) 7:190.
Zanetta et al., "Flow-cytometric analysis of deoxyribonucleic acid content in advanced ovarian carcinoma: its importance in long-term survival," Am J Obstet Gynecol (1996) 175(5): 1217-1225.
Zelefsky et al., "Neoadjuvant hormonal therapy improves the therapeutic ratio in patients with bulky prostatic cancer treated with three-dimensional conformal radiation therapy," Int J Radiat Oncol Biol Phvs. (1994) 29:755-761.
Zelefsky et al., "High dose radiation delivered by intensity modulated conformal radiotherapy improves the outcome of localized prostate cancer," The Journal of Urology (Sep. 2001) 166(3):876-881.
Zhao et al., "Development and validation of a 24-gene predictor of response to postoperative radiotherapy in prostate cancer: a matched, retrospective analysis," Lancet Oncol (2016) 17, pp. 1612-1620.
GenBank Accession No. AA462934 dated Jun. 10, 1997, 2 pages.
GenBank Accession No. AA920095 dated Apr. 20, 1998, 2 pages.
GenBank Accession No. AB028840 dated Jan. 12, 2000, 2 pages.
GenBank Accession No. AB030836 dated Oct. 23, 1999, 2 pages.
GenBank Accession No. AB036741 dated Dec. 22, 2000, 3 pages.
GenBank Accession No. AF077349 dated Dec. 14, 2000, 2 pages.
GenBank Accession No. AF077351 dated Dec. 20, 2000, 3 pages.
GenBank Accession No. AF115517 dated Nov. 23, 2005, 4 pages.
GenBank Accession No. AI413910 dated Feb. 9, 1999, 2 pages.
GenBank Accession No. AI414999 dated Feb. 9, 1999, 2 pages.
GenBank Accession No. AI425960 dated Mar. 9, 1999, 2 pages.
GenBank Accession No. AI851940 dated Jul. 15, 1999, 2 pages.
GenBank Accession No. AK018022 dated Sep. 19, 2008, 4 pages.
GenBank Accession No. AK019341 dated Sep. 19, 2008, 3 pages.
GenBank Accession No. AK019342 dated Sep. 19, 2008, 3 pages.
GenBank Accession No. AK034387 dated Sep. 19, 2008, 4 pages.
GenBank Accession No. AK038229 dated Sep. 19, 2008, 4 pages.
GenBank Accession No. AK038434 dated Sep. 19, 2008, 4 pages.
GenBank Accession No. AK041534 dated Sep. 19, 2008, 4 pages.
GenBank Accession No. AK042683 dated Sep. 19, 2008, 4 pages.
GenBank Accession No. AK136096 dated Sep. 19, 2008, 4 pages.
GenBank Accession No. AK136101 dated Sep. 19, 2008, 4 pages.
GenBank Accession No. AK142768 dated Sep. 19, 2008, 3 pages.
GenBank Accession No. AL591433 dated Jan. 15, 2009, 56 pages.
GenBank Accession No. BC004702 dated Jul. 15, 2006, 3 pages.
GenBank Accession No. BC055737 dated Jul. 15, 2006, 2 pages.
GenBank Accession No. BC086799 dated Sep. 21, 2006, 3 pages.
GenBank Accession No. BF449664 dated Dec. 1, 2000, 1 page.
GenBank Accession No. BG063957 dated Jan. 26, 2001, 2 pages.
GenBank Accession No. BG077309 dated Dec. 17, 2003, 2 pages.
GenBank Accession No. BM114282 dated Jan. 30, 2002, 2 pages.
GenBank Accession No. BY023910 dated Dec. 6, 2002, 2 pages.
GenBank Accession No. CN724527 dated May 18, 2004, 2 pages.
GenBank Accession No. NM_000130 dated Oct. 18, 2009, 6 pages.
GenBank Accession No. NM_000493 dated Mar. 15, 2009, 4 pages.
GenBank Accession No. NM_000598, GI No. 62243067 , dated Jun. 6, 2010, 5 pages.
GenBank Accession No. NM_000688, GI No. 40316942, dated Apr. 11, 2010, 5 pages.
GenBank Accession No. NM_001013398; GI No. 62243247, dated Jun. 6, 2010, 5 pages.
GenBank Accession No. NM_001034 dated Oct. 5, 2009, 5 pages.
GenBank Accession No. NM_001 039573, GI No. 221316683, dated Mar. 4, 2010, 5 pages.
GenBank Accession No. NM_001049 dated Jun. 21, 2009, 4 pages.
GenBank Accession No. NM_001067 dated Oct. 18, 2009, 5 pages.
GenBank Accession No. NM_001098533, GI No. 237858579, dated May 7, 2010, 5 pages.
GenBank Accession No. NM_001130851; GI No. 195927024, dated Mar. 5, 2010, 4 pages.
GenBank Accession No. NM_001136154 dated Jan. 8, 2012, 6 pages.
GenBank Accession No. NM_001136155 dated Jan. 8, 2012, 6 pages.
GenBank Accession No. NM_001143998, GI No. 221316675, dated Mar. 4, 2010, 5 pages.
GenBank Accession No. NM_001143999, GI No. 221316679, dated Mar. 5, 2010, 5 pages.
GenBank Accession No. NM_001144001, GI No. 221316686, dated Mar. 4, 2010, 5 pages.
GenBank Accession No. NM_001160367, GI No. 237858581, dated May 7, 2010, 5 pages.
GenBank Accession No. NM_001786 dated Nov. 1, 2009, 4 pages.
GenBank Accession No. NM_001844 dated Sep. 28, 2009, 7 pages.
GenBank Accession No. NM_003003, GI No. 221316681, dated Mar. 4, 2010, 5 pages.
GenBank Accession No. NM_003014; GI No. 170784837, dated Mar. 13, 2010, 5 pages.
GenBank Accession No. NM_003184; GI No. 115527086, dated Mar. 4, 2010, 7 pages.
GenBank Accession No. NM_003873.3 dated Oct. 18, 2009, 4 pages.
GenBank Accession No. NM_004336; GI No. 211938448, dated Mar. 14, 2010, 6 pages.
GenBank Accession No. NM_004449 dated Jan. 8, 2012, 6 pages.
GenBank Accession No. NM_005025.2 dated Jul. 12, 2009, 4 pages.
GenBank Accession No. NM_005192, GI No. 195927023, dated Mar. 4, 2010, 4 pages.
GenBank Accession No. NM_005651.1 dated Oct. 27, 2009, 3 pages.
GenBank Accession No. NM_006265, GI No. 208879448, dated Apr. 11, 2010, 6 pages.
GenBank Accession No. NM_006558 dated 812109, 3 pages.
GenBank Accession No. NM_006727 dated Oct. 18, 2009, 3 pages.
GenBank Accession No. NM_006819; GI No. 110225356, dated May 17, 2010, 5 pages.
GenBank Accession No. NM_012152; GI No. 183396778, dated Apr. 5, 2010, 5 pages.
GenBank Accession No. NM_014846; GI No. 120952850, dated Mar. 4, 2010, 6 pages.
GenBank Accession No. NM_016623; GI No. 42734437, dated Mar. 29, 2009, 4 pages.
GenBank Accession No. NM_018930 dated Feb. 10, 2008, _pages.
GenBank Accession No. NM_031966 GI No. 34304372, dated Jun. 6, 2010, 5 pages.
GenBank Accession No. NM_032334; GI No. 223468686, dated Mar. 5, 2010, 3 pages.
GenBank Accession No. NM_052987, GI No. 237858574, dated May 17, 2010, 5 pages.
GenBank Accession No. NM_052988, GI No. 237858573, dated May 17, 2010, 5 pages.
GenBank Accession No. NM_080546; GI No. 112363101, dated May 17, 2010, 6 pages.
GenBank Accession No. NM_080607 dated Sep. 3, 2009, 2 pages.
GenBank Accession No. NM_133445 dated Sep. 20, 2009, 5 pages.
GenBank Accession No. NM_138455; GI No. 34147546, dated May 7, 2010, 3 pages.
GenBank Accession No. NM_182918 dated Jan. 8, 2012, 6 pages.
GenBank Accession No. NM_199166, GI No. 40316938, dated Apr. 11, 2010, 5 pages.
GenBank Accession No. NP_001058 dated Dec. 25, 2011, 9 pages.

(56) References Cited

OTHER PUBLICATIONS

GenBank Accession No. W34764 dated May 13, 1996, 2 pages.
Supplemental Table 1 of U.S. Appl. No. 61/057,698, filed May 30, 2008, 13 pages.
Supplemental Table 2 of U.S. Appl. No. 61/057,698, filed May 30, 2008, 15 pages.
Supplemental Table 3 of U.S. Appl. No. 61/057,698, filed May 30, 2008, 21 pages.
Supplemental Table 4 of U.S. Appl. No. 61/057,698, filed May 30, 12008, 1 page.
Supplemental Table 5 of U.S. Appl. No. 61/057,698, filed May 30, 12008, 2 pages.
Supplemental Table 6 of U.S. Appl. No. 61/057,698, filed May 30, 2008, 1 page.
Adamo and Ladomery, "The Oncogene ERG: A Key Factor in Prostate Cancer," *Oncogene*(2016), 35:403-414.
Affymetrix GeneChip Human Genome U133 Array Set HG-U133A, Geo, Mar. 11, 2002, retrieved on Mar. 11, 2002.
Anonymous, UCSC Genome Browser on Human Mar. 2006, NCBI36/hg18) Assembly, Mar. 2006, XP055587638, Retrieved from the Internet: URL:https://genome-euro.ucsc.edu/cgi-bin/hgTracks?db=hg18&lastVirtModeType=default&lastVirtModeExtraState=&virtModeType=default&virtMode=0&nonVirtPosition=&position=chr5%3A 14025126%2D14062770&hgsid=232148223_IYIy9VS0Lh0jhldEBQ3nViBrQuB5 [retrieved on May 10, 2019].
Bismar et al., "ERG Protein Expression Reflects Hormonal Treatment Response and is Associated with Gleason Score and Prostate Cancer Specific Mortality," *Eur. J. Cancer* (2012), 48:538-546,Elsevier Ltd.
Biton et al., Nov. 20, 2014, Independent component analysis uncovers the landscape of the bladder tumor transcriptome and reveals insights into luminal and basal subtypes, Cell Reports, 9(4):1235-1245.
Blute et al., "Use of Gleason score, prostate specific antigen, seminal vesicle and margin status to predict biochemical failure after radical prostatectomy," J Urol (2001) 165: 119-125.
Bueno et al., "A diagnostic test for prostate cancer from gene expression profiling data," J Urol, Feb. 2004; 171(2 Pt 1):903-6.
Choi et al., Feb. 2014, Identification of distinct basal and luminal subtypes of muscle-invasive bladder cancer with different sensitivities to frontline chemotherapy, Cancer Cell, 25(2):152-165.
Choi et al., Jun. 24, 2014, Intrinsic basal and luminal subtypes of muscle-invasive bladder cancer, Nature Reviews Urology, 11(7):400-410.
Cooper et al., "Mechanisms of Disease: biomarkers and molecular targets from microarray gene expression studies in prostate cancer," Nat Clin Pract Urol. (2007) Dee:4(12):677-87.
Cordon-Cardo et al., "Improved prediction of prostate cancer recurrence through systems pathology," The Journal of Clinical Investigation (Jul. 2007) vol. 117, No. 7, pp. 1876-1883.
Den et al., Mar. 10, 2015, Genomic classifier identifies men with adverse pathology after racial prostatectomy who benefit from adjuvant radiation therapy, Journal of Clinical Oncology, 33(8):944-951.
Dhani et al., 2011, Phase II study of cytarabine in men with docetaxel-refractory, castration-resistnt prostate cancer with evaluation of TMPRSS2-ERG and SPINK1 as serum biomarkers, BJUI, 110:840-845.
Epstein et al., "Prognostic factors and reporting of prostate carcinoma in radical AU prostatectomy and pelvic lymphadenectomy specimens," Scand. J. Urol. Nephrol. Suppl. (2005) 216:34-63.
Fine et al., "A Proportional Hazards Model for the Subdistribution of a Competing Risk," Journal of the American Statistical Association (1999) vol. 94 (446), pp. 496-509.
Galavotti et al., Apr. 2012, The autophagy-associated factors DRAM1 and p62 regulate cell migration and invasion in glioblastoma stem cells, Oncogene, 32:699-712.
Gleason: "Histologic grading and clinical staging of prostatic carcinoma", Urologic pathology: the prostate, (Tannenbaum, ed.) (1977) Lea & Febiger, Philadelphia, PA, pp. 171-197.
Gleason: "Histologic grading of prostate cancer: a perspective"; Hum. Pathol. (1992) 23(3):273-279.
Grambsch et al., "Proportional Hazards Tests and Diagnostics Based on Weighted Residuals," Biometrika (2013) vol. 81 (3), pp. 515-526.
Ha et al., Nov. 12, 2009, Comparison of affymetrix gene array with the exon array shows potential application for detection of transcript isoform variation, BMC Genomics, 19(1):519.
Heagerty et al., "Time-Dependent ROC Curves for Censored Survival Data and a Diagnostic Marker," Biometrics (2000) vol. 56 (2), pp. 337-344.
Humphrey et al: "Histologic grade, DNA ploidy, and intraglandular tumor extent as indicators of tumor progression of clinical Stage B prostatic carcinoma"; Am J Surg Pathol (1991) 15(12):1165-1170.
Knowles et al., Dec. 23, 2014, Molecular biology of bladder cancer: new insights into pathogenesis and clinical diversity, Nature Reviews Cancer, 15(1):25-41.
Lin et al., "Nuclear receptor-induced chromosomal proximity and DNA breaks underlie specific translocations in cancer," Cell (Dec. 11, 2009) 139(6):1069-83.
Liu et al., 2014, Synergistic killing of lung cancer cells by cisplatin and radiation via autophagy and apoptosis, Oncology Letters, 7:1903-1910.
McConkey et al., Apr. 2015, Therapeutic opportunities in the intrinsic subtypes of muscle-invasive bladder cancer, Hematology/Oncology Clinics of North America, 29(2):377-394.
McConkey et al., May 2016, A prognostic gene expression signature in the molecular classification of chemotherapy-naive urothelial cancer is predictive of clinical outcomes from neoadjuvant chemotherapy: a phase 2 trial of dose-dense methotrexate, vinblastine, doxorubicin, and cisplatin with bevacizumab in urothelial cancer, European Urology, 69(5):855-862.
Mendiratta et al., "Genomic signatures associated with the development, progression, rand outcome of prostate cancer," Molecular diagnosis & therapy (2007) 11(6):345-54.
Nelson, "Predicting prostate cancer behavior using transcript profiles," J Urol. (Nov. 2004) 172(5 Pt 2):S28-32; discussion S33.
Ozen et al., Sep. 24, 2007, Widespread deregulation of microRNA expression in human prostate cancer, Oncogene, 27:1788-1793.
Probe Set Listing for the Affymetrix Human Genome U133 Plus 2.0 array (Accessed from https://www.affymetrix.com/analysis/index.affx on Jul. 1, 2015) (Year: 2015).
Reddy et al., "Clinical utility of microarray-derived genetic signatures in predicting outcomes in prostate cancer," Clinical Genitourinary Cancer (2006) 5(3):187-189.
Schlomm et al., "Molecular staging of prostate cancer in the year 2007," World .J. Urol. (Mar. 2007) 25(1):19-30.
Seiler et al., Oct. 2017, Impact of molecular subtypes in muscle-invasive bladder cancer on predicting response and survival after neoadjuvant chemotherapy, European Urology, 72(4):544-554.
Smit et al., "High-Resolution ERG-Expression Profiling on GeneChip Exon 1.0 ST Arrays in Primary and Castration-Resistant Prostate Cancer," *BJU International* (2013), 111(5):836-842, BJU International.
Solo et al., "Prevalence of prostate cancer (PC) clinical states (CS) in the United States: Estimates using a dynamic progression model," ASCO Annual Meeting, Journal of Clinical Oncology (May 20, 2011) vol. 29, No. 15, Abstract 4637.
Stephenson et al., "Postoperative Nomogram Predicting the 10-Year Probability of Prostate Cancer Recurrence After Radical Prostatectomy," J Clin Oncol (2008) vol. 23 (28), pp. 7005-7012.
Talantov et al., "Gene Based Prediction of Clinically Localized Prostate Cancer Progression After Radical Prostatectomy," The Journal Of Urology (Oct. 2010) vol. 184, 1521-1528.
Thompson et al., "Is the GPSM scoring algorithm for patients with prostate cancer valid in the contemporary era?" J Urol. (Aug. 2007) vol. 178 (2), 459-463.
Warrick et al., 2016, FOXA1, GATA3 and PPARγ cooperate to drive luminal subtype in bladder cancer: a molecular analysis of established human cell lines, Scientific Reports, 6:38531, DOI: 10.1038, 15 pp.

(56) References Cited

OTHER PUBLICATIONS

Damrauer et al., Feb. 25, 2014, Intrinsic subtypes of high-grade bladder cancer reflect the hallmarks of breast cancer biology, Proc Natl Acad Sci USA, 111(8):3110-3115.
International Search Report and Written Opinion dated Jul. 26, 2018 in PCT/CA2018/050060.

* cited by examiner

MOLECULAR SUBTYPING, PROGNOSIS, AND TREATMENT OF BLADDER CANCER

CROSS-REFERENCE TO RELATED APPLICATIONS

This application claims benefit of priority under 35 U.S.C. § 119(e) of U.S. Ser. No. 62/448,921, filed Jan. 20, 2017, the entire contents of which is incorporated herein by reference in its entirety.

INCORPORATION OF SEQUENCE LISTING

The material in the accompanying sequence listing is hereby incorporated by reference into this application. The accompanying sequence listing text file, name GBX1270_1_Sequence_Listing, was created on Jan. 19, 2018, and is 1100 kb. The file can be assessed using Microsoft Word on a computer that uses Windows OS.

FIELD OF THE INVENTION

The present invention pertains to the field of personalized medicine and methods for treating bladder cancer. In particular, the invention relates to the use of genomic signatures to identify individuals in need of treatment for bladder cancer who will be responsive to neoadjuvant chemotherapy. The present invention also provides methods and compositions for treating bladder cancer.

BACKGROUND OF THE INVENTION

Cancer is the uncontrolled growth of abnormal cells anywhere in a body. The abnormal cells are termed cancer cells, malignant cells, or tumor cells. Many cancers and the abnormal cells that compose the cancer tissue are further identified by the name of the tissue that the abnormal cells originated from (for example, bladder cancer). Cancer cells can proliferate uncontrollably and form a mass of cancer cells. Cancer cells can break away from this original mass of cells, travel through the blood and lymph systems, and lodge in other organs where they can again repeat the uncontrolled growth cycle. This process of cancer cells leaving an area and growing in another body area is often termed metastatic spread or metastatic disease. For example, if bladder cancer cells spread to a bone (or anywhere else), it can mean that the individual has metastatic bladder cancer.

Standard clinical parameters such as tumor size, grade, lymph node involvement and tumor—node metastasis (TNM) staging (American Joint Committee on Cancer, cancerstaging.org) may correlate with outcome and serve to stratify patients with respect to (neo)adjuvant chemotherapy, immunotherapy, antibody therapy and/or radiotherapy regimens. Incorporation of molecular markers in clinical practice may define tumor subtypes that are more likely to respond to targeted therapy. However, stage-matched tumors grouped by histological or molecular subtypes may respond differently to the same treatment regimen. Additional key genetic and epigenetic alterations may exist with important etiological contributions. A more detailed understanding of the molecular mechanisms and regulatory pathways at work in cancer cells and the tumor microenvironment (TME) could dramatically improve the design of novel anti-tumor drugs and inform the selection of optimal therapeutic strategies. The development and implementation of diagnostic, prognostic and therapeutic biomarkers to characterize the biology of each tumor may assist clinicians in making important decisions with regard to individual patient care and treatment.

Neoadjuvant cisplatin-based chemotherapy (NAC) is standard treatment in muscle-invasive bladder cancer (MIBC) prior to radical cystectomy (Bajorin et al. (2011) J. Clin. Oncol. 29(16):2135-2137; Grossman et al. (2003) N. Engl. J. Med. 349(9):859-866; International Collaboration of Trialists et al. (2011) J. Clin. Oncol. 29(16):2171-2177). Although NAC improves pathological down-staging and improves patient survival, only approximately 40% of patients experience a major response (Zargar et al. (2015) Eur. Urol. 67(2):241-249). The non-responding patients are unlikely to derive clinical benefit, are exposed to substantial toxicity, and experience a delay in definitive local therapy (Grossman et al., supra; International Collaboration of Trialists et al., supra). The identification of molecular markers of non-responsiveness is essential for more precise delivery of care. Recent analyses suggest that specific mutations, especially in ERCC2 and DNA repair genes, may predict response to NAC (Liu et al. (2016) JAMA Oncol. 2(8):1094-1096).

Recent identification of molecular gene expression subtypes has advanced our understanding of the biology of bladder cancer (Biton et al. (2014) Cell Rep 9(4):1235-1245; Cancer Genome Atlas Research Network (2014) Nature 507(7492):315-232; Choi et al. (2014) Cancer Cell 25(2): 152-165; Damrauer et al. (2014) Proc. Natl. Acad. Sci. USA 111(8): 3110-3115; Sjodahl et al. (2012) Clin. Cancer Res. 18(12):3377-3386; Volkmer et al. (2012) Proc. Natl. Acad. Sci. USA 109(6):2078-2083). Molecular classification provides a framework for further study and has potential implications for the clinical management of MIBC. Four different molecular subtyping schemes have been previously described (Cancer Genome Atlas Research Network, supra; Choi et al., supra; Damrauer et al., supra; Sjodahl et al., supra). Each was developed on different patient populations, unique genomic platforms, and only one was based on integrative multiplatform genomic analysis (Cancer Genome Atlas Research Network, supra). Despite these differences, each identifies molecular phenotypes that share many similarities, and they represent a division into basal and luminal tumors at a higher level, with different subclassifications that are specific to each system.

Choi et al (MDA group) first introduced the concept that molecular subtypes may predict response to NAC. In three cohorts with a total of 100 patients, a subset classified as "p53-like" tumors demonstrated a lower response rate to cisplatin-based combination chemotherapy (Choi et al., supra). This finding has not been validated in additional larger patient cohorts and has not been investigated with the other subtyping methods. Furthermore, none of the four subtyping models is suitable for clinical implementation because each requires classification of an entire patient cohort in order to assign an individual patient sample to a subtype. Thus, improved methods are needed for subtyping bladder cancer that better predict a patient's response to NAC.

This background information is provided for the purpose of making known information believed by the applicant to be of possible relevance to the present invention. No admission is necessarily intended, nor should be construed, that any of the preceding information constitutes prior art against the present invention.

SUMMARY OF THE INVENTION

The present invention relates to methods, systems and kits for the diagnosis, prognosis, and treatment of bladder cancer in a subject. The invention also provides biomarkers that define subgroups of bladder cancer, clinically useful classifiers for distinguishing bladder cancer subtypes, bioinformatic methods for determining clinically useful classifiers, and methods of use of each of the foregoing. The methods, systems and kits can provide expression-based analysis of biomarkers for purposes of subtyping bladder cancer in a subject. Further disclosed herein, in certain instances, are probe sets for use in subtyping bladder cancer in a subject. Classifiers for subtyping a bladder cancer and methods of treating bladder cancer based on molecular subtyping are also provided.

In one embodiment, the present invention provides a method comprising: a) providing a biological sample from a subject having bladder cancer; b) detecting the presence or expression level in the biological sample for a plurality of targets selected from Table 3, Table 5, Table 13 or SEQ ID Nos: 1-4050; and c) subtyping the bladder cancer in the subject according to a genomic subtyping classifier based on the presence or expression levels of the plurality of targets, wherein said subtyping comprises assigning the bladder cancer to one of four subtypes selected from the group consisting of a claudin-low subtype, a basal subtype, a luminal-infiltrated subtype, and a luminal non-infiltrated subtype. In some embodiments, the method further comprises administering neoadjuvant chemotherapy to the subject if the subtyping indicates that the subject has the basal subtype and administering an anti-cancer treatment other than the neoadjuvant chemotherapy to the subject if the subtyping indicates that the subject has the luminal-infiltrated subtype, the luminal non-infiltrated subtype, or the claudin-low subtype, wherein the anti-cancer treatment other than neoadjuvant chemotherapy is selected from the group consisting of surgery, chemotherapy, radiation therapy, immunotherapy, biological therapy, hormonal therapy, radiation therapy, immunotherapy and photodynamic therapy. In certain embodiments the chemotherapy is selected from cisplatin, mitomycin, fluorouracil (5-FU), gemcitabine, methotrexate, vinblastine, doxorubicin, carboplatin, paclitaxel, docetaxel or a combination thereof.

In one embodiment, the present invention provides a method comprising: a) providing a biological sample from a subject having bladder cancer; b) detecting the presence or expression level in the biological sample for a plurality of targets selected from Table 10 and c) subtyping the bladder cancer in the subject according to a genomic subtyping classifier based on the presence or expression levels of the plurality of targets, wherein said subtyping comprises assigning the bladder cancer to one of four subtypes selected from the group consisting of a claudin-low subtype, a basal subtype, a luminal-infiltrated subtype, and a luminal non-infiltrated subtype.

In one embodiment, the present invention provides a method comprising: a) providing a biological sample from a subject having bladder cancer; b) detecting the presence or expression level in the biological sample for a plurality of targets selected from the group consisting of LAMC2, IFI30, SAA1, VIM, TGFBI, TIMP2, GBP1, SNAI2, GBP5, POSTN, TNC, F3, BGN, CCL5, SULF1, WARS, MMP3, CXCL10, TIMP3, SERPINB1, DDIT4, MET, MYADM, CD68, COL1A1, ENO1, THBS1, CD44, MT1L, ACER2, ACOX1, ACSL5, ACTA2, ACTG2, AHR, AKR1C2, ANXA1, BAMBI, BTG2, CASP14, CDH1, CLDN1, COL1A2, CPSF6, CSTA, CTSK, CXCL1, CXCL9, CYP1A1, DAPK1, DES, DUSP1, EFEMP1, ERP27, F11R, FCGR3A, FLNA, FN1, G0S2, GRHL1, HIST1H2AE, HIST1H2BF, HLA-DRA, HLA-DRB1, HLA-DRB5, HMGCS2, IFI16, IFI6, IFITM2, IGFL1, INA, ITGA6, KRT19, KRT8, LAPTM5, LUM, LYZ, MAL, MALL, MMP1, MMP12, MT1E, MYL9, OLFM4, PABPC1, PAQR7, PERP, PM20D1, PPARG, PSCA, PTMS, PTPN13, PTPRM, RALBP1, RNF128, RNF138P1, S100A10, S100A7, S100A8, SAMD9, SCCPDH, SCNN1A, SCNN1B, SCUBE2, SEMA5A, SERPINB13, SERPINB3, SERPINB4, SFN, SFRP2, SLITRK6, SNCG, SPINK1, SPP1, SPRR1B, STS, SYTL2, TACSTD2, TGM2, THBS2, TMEM45A, TMEM45B, TMPRSS2, TMSB10, TOX3, TPM2, TPX2, TWIST2, UPK1A, UPK1B, VCAN, VGLL1, VSIG2, ZNF486, UGT1A1, BEX4, UGT1A9, CXCL17, IGFBP3, UGT1A3, UGT1A5, SLC14A1, GPR110, TNFRSF21, FLRT3, ELF3, S100, PGATA3, UGT1A10, GABRP, GRHL3, MACC1, EHF, UGT1A8, MGP, and ERBB2; and c) subtyping the bladder cancer in the subject according to a genomic subtyping classifier based on the presence or expression levels of the plurality of targets, wherein said subtyping comprises assigning the bladder cancer to one of four subtypes selected from the group consisting of a claudin-low subtype, a basal subtype, a luminal-infiltrated subtype, and a luminal non-infiltrated subtype.

In one embodiment, the present invention provides a method comprising: a) providing a biological sample from a subject having bladder cancer and b) detecting the presence or expression level in the biological sample for a plurality of targets selected from Table 10. In some embodiments, the method further comprises subtyping the bladder cancer in the subject according to a genomic subtyping classifier based on the presence or expression levels of the plurality of targets, wherein said subtyping comprises assigning the bladder cancer to one of four subtypes selected from the group consisting of a claudin-low subtype, a basal subtype, a luminal-infiltrated subtype, and a luminal non-infiltrated subtype. In some embodiments, the method further comprises administering neoadjuvant chemotherapy to the subject if the subtyping indicates that the subject has the basal subtype and administering an anti-cancer treatment other than the neoadjuvant chemotherapy to the subject if the subtyping indicates that the subject has the luminal-infiltrated subtype, the luminal non-infiltrated subtype, or the claudin-low subtype, wherein the anti-cancer treatment is selected from the group consisting of surgery, chemotherapy, radiation therapy, immunotherapy, biological therapy, hormonal therapy, radiation therapy, immunotherapy and photodynamic therapy. In certain embodiments the chemotherapy is selected from cisplatin, mitomycin, fluorouracil (5-FU), gemcitabine, methotrexate, vinblastine, doxorubicin, carboplatin, paclitaxel, docetaxel or a combination thereof.

In one embodiment, the present invention provides a method comprising: a) providing a biological sample from a subject having bladder cancer and b) detecting the presence or expression level in the biological sample for a plurality of targets selected from the group consisting of LAMC2, IFI30, SAA1, VIM, TGFBI, TIMP2, GBP1, SNAI2, GBP5, POSTN, TNC, F3, BGN, CCL5, SULF1, WARS, MMP3, CXCL10, TIMP3, SERPINB1, DDIT4, MET, MYADM, CD68, COL1A1, ENO1, THBS1, CD44, MT1L, ACER2, ACOX1, ACSL5, ACTA2, ACTG2, AHR, AKR1C2, ANXA1, BAMBI, BTG2, CASP14, CDH1, CLDN1, COL1A2, CPSF6, CSTA, CTSK, CXCL1, CXCL9, CYP1A1, DAPK1, DES, DUSP1, EFEMP1, ERP27, F11R, FCGR3A, FLNA, FN1, G0S2, GRHL1, HIST1H2AE, HIST1H2BF, HLA-DRA, HLA-DRB1, HLA-DRB5, HMGCS2, IFI16, IFI6, IFITM2, IGFL1, INA, ITGA6, KRT19, KRT8, LAPTM5, LUM, LYZ, MAL, MALL, MMP1, MMP12, MT1E, MYL9, OLFM4, PABPC1, PAQR7, PERP, PM20D1, PPARG, PSCA, PTMS, PTPN13, PTPRM, RALBP1, RNF128, RNF138P1, S100A10, S100A7, S100A8, SAMD9, SCCPDH, SCNN1A, SCNN1B, SCUBE2, SEMASA, SERPINB13, SERPINB3, SERPINB4, SFN, SFRP2, SLITRK6, SNCG, SPINK1, SPP1, SPRR1B, STS, SYTL2, TACSTD2, TGM2, THBS2, TMEM45A, TMEM45B, TMPRSS2, TMSB10, TOX3, TPM2, TPX2, TWIST2, UPK1A, UPK1B, VCAN, VGLL1, VSIG2, ZNF486, UGT1A1, BEX4, UGT1A9, CXCL17, IGFBP3, UGT1A3, UGT1A5, SLC14A1, GPR110, TNFRSF21, FLRT3, ELF3, S100, PGATA3, UGT1A10, GABRP, GRHL3, MACC1, EHF, UGT1A8, MGP, and ERBB2.

In some embodiments, the method further comprises subtyping the bladder cancer in the subject according to a genomic subtyping classifier based on the presence or expression levels of the plurality of targets, wherein said subtyping comprises assigning the bladder cancer to one of four subtypes selected from the group consisting of a claudin-low subtype, a basal subtype, a luminal-infiltrated subtype, and a luminal non-infiltrated subtype. In some embodiments, the method further comprises administering neoadjuvant chemotherapy to the subject if the subtyping indicates that the subject has the basal subtype and administering an anti-cancer treatment other than the neoadjuvant chemotherapy to the subject if the subtyping indicates that the subject has the luminal-infiltrated subtype, the luminal non-infiltrated subtype, or the claudin-low subtype, wherein the anti-cancer treatment other than neoadjuvant chemotherapy is selected from the group consisting of surgery, chemotherapy, radiation therapy, immunotherapy, biological therapy, hormonal therapy, and photodynamic therapy.

In another embodiment, the present invention provides a method for treating a subject with bladder cancer, the method comprising: a) providing a biological sample from the subject; b) detecting the presence or expression level in the biological sample for a plurality of targets selected from Table 3, Table 5, Table 13 or SEQ ID Nos: 1-4050; and c) administering a treatment to the subject, wherein the treatment is selected from the group consisting of neoadjuvant chemotherapy or an anti-cancer treatment. In some embodiments, the anti-cancer treatment is selected from the group consisting of surgery, chemotherapy, radiation therapy, immunotherapy, biological therapy, hormonal therapy, and photodynamic therapy.

In other embodiments, the present invention provides a method for treating a subject with bladder cancer, the method comprising: a) providing a biological sample from the subject; b) detecting the presence or expression level in the biological sample for a plurality of targets selected from Table 3, Table 5, Table 13 or SEQ ID Nos: 1-4050; c) subtyping the bladder cancer in the subject according to a genomic subtyping classifier based on the presence or expression levels of the plurality of targets, wherein said subtyping comprises assigning the bladder cancer to one of four subtypes selected from the group consisting of a claudin-low subtype, a basal subtype, a luminal-infiltrated subtype, and a luminal non-infiltrated subtype; and d) administering neoadjuvant chemotherapy to the subject if the subtyping indicates that the subject has the basal subtype and administering an anti-cancer treatment other than the neoadjuvant chemotherapy to the subject if the subtyping indicates that the subject has the luminal-infiltrated subtype, the luminal non-infiltrated subtype, or the claudin-low subtype, wherein the anti-cancer treatment other than neoadjuvant chemotherapy is selected from the group consisting of surgery, chemotherapy, radiation therapy, immunotherapy, biological therapy, hormonal therapy, and photodynamic therapy.

In one aspect the invention includes a method for predicting benefit from neoadjuvant chemotherapy and treating a subject for bladder cancer, the method comprising: a) providing a biological sample from the subject; b) detecting the presence or expression level in the biological sample for a plurality of targets selected from Table 3, Table 5, Table 13 or SEQ ID Nos: 1-4050; and c) subtyping the bladder cancer in the subject according to a genomic subtyping classifier based on the presence or expression levels of the plurality of targets, wherein said subtyping comprises assigning the bladder cancer to one of four subtypes selected from the group consisting of a claudin-low subtype, a basal subtype, a luminal-infiltrated subtype, and a luminal non-infiltrated subtype; and d) administering neoadjuvant chemotherapy to the subject if the subtyping indicates that the subject has the basal subtype and administering an anti-cancer treatment other than the neoadjuvant chemotherapy to the subject if the subtyping indicates that the subject has the luminal-infiltrated subtype, the luminal non-infiltrated subtype, or the claudin-low subtype, wherein the anti-cancer treatment other than neoadjuvant chemotherapy is selected from the group consisting of surgery, chemotherapy, radiation therapy, immunotherapy, biological therapy, hormonal therapy, and photodynamic therapy. In one embodiment, the neoadjuvant chemotherapy comprises administering cisplatin. In another embodiment, the subject has muscle-invasive bladder cancer. In some embodiments, the biological sample comprises bladder cancer cells. In other embodiments, the biological sample comprises nucleic acids (e.g., RNA or DNA).

The method may be performed prior to treatment of the subject with neoadjuvant chemotherapy to determine if the subject will benefit from neoadjuvant chemotherapy or should be administered some other anti-cancer treatment. The method may also be performed while the subject is undergoing neoadjuvant chemotherapy to help evaluate whether continued treatment is likely to be efficacious.

The biological sample obtained from a patient is typically urine, a biopsy, blood or a tumor sample, but can be any sample from bodily fluids or tissue of the patient that contains cancerous cells or nucleic acids (e.g., RNA, DNA). In certain embodiments, nucleic acids (e.g., RNA transcripts) comprising sequences from targets selected from Table 3, Table 5, Table 13 or SEQ ID Nos: 1-4050, or complements thereof, are further isolated from the biological sample, and/or purified, and/or amplified prior to analysis.

The presence or expression level of biomarker nucleic acids can be determined by using a variety of methods including, but not limited to, in situ hybridization, a PCR-based method, an array-based method, an immunohistochemical method, a sequencing method (e.g., next-generation sequencing), an RNA assay method, or an immunoassay method.

In some embodiments, the invention provides a method of subtyping bladder cancer in a subject, comprising: providing a biological sample from the subject, and detecting the presence or expression level in the biological sample for a plurality of targets selected from Table 3, Table 5, Table 13 or SEQ ID Nos: 1-4050; wherein the presence or expression level of the plurality of targets provides an indication of the bladder cancer subtype. In some embodiments, the biological sample comprises bladder cancer cells. In other embodiments, the biological sample comprises nucleic acids. In some embodiments, the expression level of at least one target is reduced compared to a control. In other embodiments, the expression level of at least one target is increased compared to a control. In yet other embodiments, the level of expression of at least one target is determined by using a method selected from the group consisting of in situ hybridization, a PCR-based method, an array-based method, an immunohistochemical method, a sequencing method, an RNA assay method and an immunoassay method. In other embodiments, the level of expression of at least one target is detected using a reagent selected from the group consisting of a nucleic acid probe, one or more nucleic acid primers, and an antibody. In still other embodiments, determining the level of expression comprises measuring the level of a nucleic acid (e.g., RNA transcript).

In another aspect, the invention includes a method for determining a treatment for a subject who has bladder cancer, the method comprising: a) providing a biological sample from the subject; b) detecting the presence or expression level in the biological sample for a plurality of targets selected from Table 3, Table 5, Table 13 or SEQ ID Nos: 1-4050; c) subtyping the bladder cancer of the subject according to a genomic subtyping classifier based on the presence or expression levels of the plurality of targets, wherein said subtyping comprises assigning the bladder cancer to one of four subtypes selected from the group consisting of a claudin-low subtype, a basal subtype, a luminal-infiltrated subtype, and a luminal non-infiltrated subtype; and d) determining whether or not the subject is likely to be responsive to neoadjuvant chemotherapy based on the subtype of the bladder cancer in the subject; and prescribing neoadjuvant chemotherapy to the subject if the patient is identified as likely to be responsive to neoadjuvant chemotherapy, or prescribing a cancer treatment other than neoadjuvant chemotherapy to the subject if the subject is not identified as likely to be responsive to neoadjuvant chemotherapy. In some embodiments, the biological sample comprises bladder cancer cells. In other embodiments, the biological sample comprises nucleic acids.

In another aspect, the invention includes a probe set for predicting benefit from neoadjuvant chemotherapy in a subject who has bladder cancer, the probe set comprising a plurality of probes for detecting a plurality of targets, wherein the plurality of targets comprises one or more target sequences, or complements thereof, of targets selected from Table 3, Table 5, Table 13 or SEQ ID Nos: 1-4050, or a combination thereof. Probes may be detectably labeled to facilitate detection.

In another aspect, the invention includes a system for analyzing a bladder cancer to predict response of a subject to neoadjuvant chemotherapy, the system comprising: a) a probe set described herein; and b) a computer model or algorithm for analyzing an expression level or expression profile of the plurality of target nucleic acids hybridized to the plurality of probes in a biological sample from a subject who has bladder cancer and subtyping the bladder cancer of the subject according to a genomic subtyping classifier based on the expression level or expression profile, wherein said subtyping comprises assigning the bladder cancer to one of four subtypes selected from the group consisting of a claudin-low subtype, a basal subtype, a luminal-infiltrated subtype, and a luminal non-infiltrated subtype.

In another aspect, the invention includes a kit for predicting response of a subject to neoadjuvant chemotherapy, the kit comprising agents for detecting the presence or expression levels for a plurality of targets, wherein said plurality of targets comprises one or more targets selected from Table 3, Table 5, Table 13 or SEQ ID Nos: 1-4050. The kit may include one or more agents (e.g., hybridization probes, PCR primers, or microarray) for detecting the presence or expression levels of a plurality of targets, wherein said plurality of targets comprises one or more targets selected from Table 3, Table 5, Table 13 or SEQ ID Nos: 1-4050, a container for holding a biological sample isolated from a human subject for testing, and printed instructions for reacting the agents with the biological sample or a portion of the biological sample to determine whether or not the subject is likely to benefit from neoadjuvant chemotherapy. In some embodiments, the biological sample comprises bladder cancer cells. In other embodiments, the biological sample comprises nucleic acids (e.g., RNA or DNA). The agents may be packaged in separate containers. The kit may further comprise one or more control reference samples or other reagents for measuring gene expression (e.g., reagents for performing PCR, RT-PCR, microarray analysis, a Northern blot, an immunoassay, or immunohistochemistry). In one embodiment, the kit comprises agents for detecting the presence or expression levels of the targets listed in Table 3, Table 5, Table 13 or SEQ ID Nos: 1-4050. In another embodiment, the kit comprises agents for detecting the presence or expression levels of all the targets listed in Table 3, Table 5, Table 13 or SEQ ID Nos: 1-4050. For example, the kit may comprise a probe set, as described herein, for detecting a plurality of targets, wherein the plurality of targets comprises one or more target sequences, or complements thereof, of targets selected from Table 3, Table 5, Table 13 or SEQ ID Nos: 1-4050, or any combination thereof.

In another embodiment, the kit further comprises a system for analyzing a bladder cancer to predict response of a subject to neoadjuvant chemotherapy, wherein the system comprises: a) a probe set comprising a plurality of probes for detecting a plurality of target nucleic acids, wherein the plurality of target nucleic acids comprises one or more target sequences, or complements thereof, of targets selected from Table 3, Table 5, Table 13 or SEQ ID Nos: 1-4050, or any combination thereof; and b) a computer model or algorithm for analyzing an expression level or expression profile of the plurality of target nucleic acids hybridized to the plurality of probes in a biological sample from a subject who has bladder cancer and subtyping the bladder cancer of the subject according to a genomic subtyping classifier based on the expression level or expression profile, wherein said subtyping comprises assigning the bladder cancer to one of four subtypes selected from the group consisting of a claudin-low subtype, a basal subtype, a luminal-infiltrated subtype, and a luminal non-infiltrated subtype.

In another aspect, the invention includes a method of diagnosing, prognosing, determining the progression of cancer, or predicting benefit from therapy in a subject with bladder cancer, comprising: a) providing a biological sample from the subject; b) assaying an expression level in the biological sample from the subject for a plurality of targets using at least one reagent that specifically binds to said targets, wherein the plurality of targets comprises one or more targets selected from Table 3, Table 5, Table 13 or SEQ ID Nos: 1-4050; and c) diagnosing, prognosing, determining the progression of cancer, or predicting benefit from therapy in the subject based on the expression level of the plurality of targets. In some embodiments, the biological sample comprises bladder cancer cells. In other embodiments, the biological sample comprises nucleic acids (e.g., RNA or DNA).

The significance of the expression levels of one or more biomarker targets of the present invention may be evaluated using, for example, a T-test, P-value, KS (Kolmogorov Smirnov) P-value, accuracy, accuracy P-value, positive predictive value (PPV), negative predictive value (NPV), sensitivity, specificity, AUC, AUC P-value (Auc.pvalue), Wilcoxon Test P-value, Median Fold Difference (MFD), Kaplan Meier (KM) curves, survival AUC (survAUC), Kaplan Meier P-value (KM P-value), Univariable Analysis Odds Ratio P-value (uvaORPval), multivariable analysis Odds Ratio P-value (mvaORPval), Univariable Analysis Hazard Ratio P-value (uvaHRPval) and Multivariable Analysis Hazard Ratio P-value (mvaHRPval). The significance of the expression level of the one or more targets may be based on two or more metrics selected from the group comprising AUC, AUC P-value (Auc.pvalue), Wilcoxon Test P-value, Median Fold Difference (MFD), Kaplan Meier (KM) curves, survival AUC (survAUC), Univariable Analysis Odds Ratio P-value (uvaORPval), multivariable analysis Odds Ratio P-value (mvaORPval), Kaplan Meier P-value (KM P-value), Univariable Analysis Hazard Ratio P-value (uvaHRPval) or Multivariable Analysis Hazard Ratio P-value (mvaHRPval).

These and other embodiments of the subject invention will readily occur to those of skill in the art in view of the disclosure herein.

INCORPORATION BY REFERENCE

All publications, patents, and patent applications mentioned in this specification are herein incorporated by reference in their entireties to the same extent as if each individual publication, patent, or patent application was specifically and individually indicated to be incorporated by reference.

BRIEF DESCRIPTION OF THE DRAWINGS

FIG. 1A shows an overview of four previously described bladder cancer subtyping methods. UNC divides the cancers in two classes, luminal and basal. Claudin-low is a subtype within basal that has lost epithelial differentiation and has a high level of immune infiltration. The MDA subtyping method also divides into basal and luminal tumors, in addition to a third subtype with an active p53-signature (p53-like). The TCGA subtyping defines four clusters that are also basal (cluster III and IV) and luminal (cluster I and II). The Lund group discovered 5 subtypes that can be considered basal (Uro B and SCC-like), luminal (Uro A and genetically unstable) and infiltrated. FIG. 1B shows a heatmap of biologically relevant gene signatures (rows) in pre-NAC TUR samples from the discovery cohort. The column annotation across the top provides the subtype calls from each classification system. FIG. 1C shows a heatmap of two bidirectional epithelial-to-mesenchymal transition signatures (Tan et al. and Kardos et al.). FIG. 1D shows enrichment plots of the hallmark EMT signature in claudin-low versus basal tumors (left) and cluster IV versus III (right). FIG. 1E and FIG. 1F shows differential expression of immune markers CXCL9 (FIG. 1E) and CD8A (FIG. 1F) in the UNC subtypes (left) and the TCGA clusters (right).

FIG. 2A shows OS stratified according to the UNC subtypes. FIG. 2B shows OS stratified according to the MDA subtypes. FIG. 2C shows OS stratified according to the TCGA clusters. FIG. 2D shows OS stratified according to the Lund subtypes.

FIG. 3A shows the proposed GSC bladder cancer classes derived from a consensus of four models (UNC, MDA, TCGA, and Lund). FIG. 3B shows the GSC cross-validation scores for each sample in the NAC dataset. FIG. 3C shows the performance of the GSC in the discovery (10-fold cross validation for model performance) and two independent validation cohorts (NAC validation cohort and non-NAC validation cohort), respectively.

FIG. 4A shows Kaplan-Meier plots for OS in non-NAC (left) and NAC (right) datasets stratified according to the classes predicted by GSC. FIGS. 4B and 4C show OS of the NAC dataset according to major pathological downstaging stratified by luminal (FIG. 4B left), basal (FIG. 4B right), luminal-infiltrated (FIG. 4C left) and claudin-low subtype (FIG. 4C right), respectively.

FIG. 6A shows a heatmap of Lund classifier genes in all pre-NAC TUR samples. FIG. 6B shows a barplot indicating the number of tumors per subtype. FIG. 6C shows that characteristic genes for each subtype were expressed in the appropriate subtypes. FIG. 6D shows a heatmap of the genes in the TGAA ClaNC model.

FIG. 7A shows a heatmap of genes in BASE47 in the pre-NAC TURBT samples. FIG. 7B shows a plot of the prediction scores for basal tumors of the BASE47 model (y-axis) and the R values of Pearson correlation to the model centroids (x-axis). FIG. 7C shows a heatmap of genes in the claudin-low classifier. FIG. 7D shows a distribution of the prediction scores of all pre-NAC TURBT samples of the claudin-low classifier shown in the histogram. FIG. 7E shows a heatmap of basal, p53-like and luminal genes from the MDA classifier in all pre-NAC TURBT samples. FIG. 7F shows the distances of test samples to the samples in the training set measured with the one Nearest Neighbor (oneNN) model.

FIG. 8A shows the differences in expression of known chemokines and immune markers between the UNC subtypes. FIG. 8B shows a comparison of expression of chemokines and immune markers between tumors in TCGA cluster I-IV. FIG. 8C shows enrichment plots of immune signatures and signatures for epithelial-to-mesenchymal transition (EMT) in claudin-low versus basal tumors. FIG. 8D shows gene enrichment in cluster IV tumors. FIG. 8E shows enrichment plots of the Hallmark inflammatory response, KEGG chemokine signaling pathway and Tan EMT signature in cluster II versus I tumors.

FIG. 9A shows an OS analysis according to the UNC subtypes. FIG. 9B shows an OS analysis according to the MDA subtypes. FIG. 9C shows an OS analysis according to the TCGA clusters. FIG. 9D shows an OS analysis according to the Lund subtypes.

DETAILED DESCRIPTION OF THE INVENTION

Figure 1A:
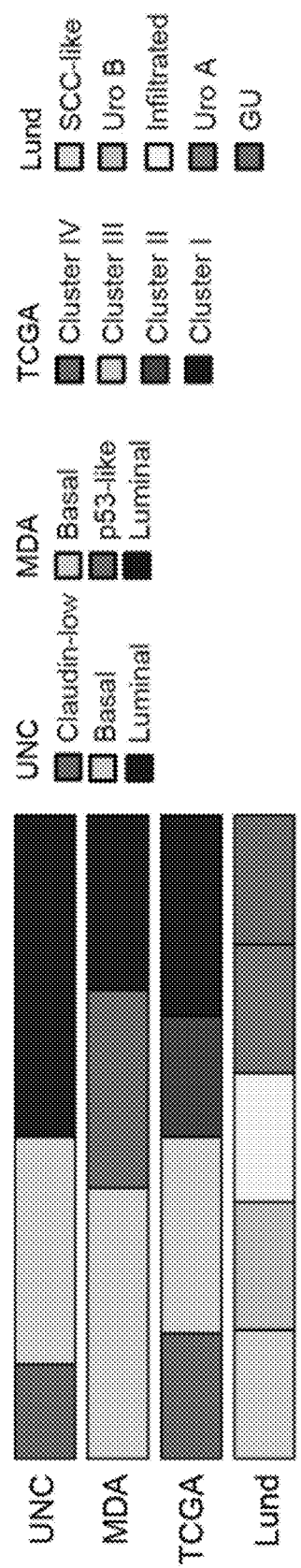
FIGS. 1A-1F show molecular subtypes in pre-NAC TURBT samples in discovery NAC cohort.

The present invention discloses systems and methods for diagnosing, predicting, and/or monitoring the status or outcome of bladder cancer in a subject using expression-based analysis of a plurality of targets. Generally, the method comprises (a) optionally providing a sample from a subject; (b) assaying the expression level of a plurality of targets in the sample; and (c) diagnosing, predicting and/or monitoring the status or outcome of a bladder cancer based on the expression level of the plurality of targets. Assaying the expression level for a plurality of targets in the sample may comprise applying the sample to a microarray. In some instances, assaying the expression level may comprise the use of an algorithm. The algorithm may be used to produce a classifier. Alternatively, the classifier may provide a probe selection region. In some instances, assaying the expression level for a plurality of targets comprises detecting and/or quantifying the plurality of targets. In some embodiments, assaying the expression level for a plurality of targets comprises sequencing the plurality of targets. In some embodiments, assaying the expression level for a plurality of targets comprises amplifying the plurality of targets. In some embodiments, assaying the expression level for a plurality of targets comprises quantifying the plurality of targets. In some embodiments, assaying the expression level for a plurality of targets comprises conducting a multiplexed reaction on the plurality of targets. In some instances, the plurality of targets comprises one or more targets selected from Table 3, Table 5, Table 13 or SEQ ID Nos: 1-4050. In some instances, the plurality of targets comprises at least about 2, at least about 3, at least about 4, at least about 5, at least about 6, at least about 7, at least about 8, at least about 9, or at least about 10 targets selected from Table 3, Table 5, Table 13 or SEQ ID Nos: 1-4050.

Further disclosed herein are methods for subtyping bladder cancer. Generally, the method comprises: (a) providing a sample from a subject; (b) assaying the expression level for a plurality of targets in the sample; and (c) subtyping the bladder cancer based on the expression level of the plurality of targets. In some instances, the plurality of targets comprises one or more targets selected from Table 3, Table 5, Table 13 or SEQ ID Nos: 1-4050. In some embodiments, the biological sample comprises bladder cancer cells. In other embodiments, the biological sample comprises nucleic acids (e.g., RNA or DNA). In some instances, the plurality of targets comprises at least about 2, at least about 3, at least about 4, at least about 5, at least about 6, at least about 7, at least about 8, at least about 9, or at least about 10 targets selected from Table 3, Table 5, Table 13 or SEQ ID Nos: 1-4050. In some instances, subtyping the bladder cancer comprises determining whether the cancer would respond to an anti-cancer therapy. Alternatively, subtyping the bladder cancer comprises identifying the cancer as non-responsive to an anti-cancer therapy. Optionally, subtyping the bladder cancer comprises identifying the cancer as responsive to an anti-cancer therapy.

Before the present invention is described in further detail, it is to be understood that this invention is not limited to the particular methodology, compositions, articles or machines described, as such methods, compositions, articles or machines can, of course, vary. It is also to be understood that the terminology used herein is for the purpose of describing particular embodiments only, and is not intended to limit the scope of the present invention.

Targets

In some instances, assaying the expression level of a plurality of genes comprises detecting and/or quantifying a plurality of target analytes. In some embodiments, assaying the expression level of a plurality of genes comprises sequencing a plurality of target nucleic acids. In some embodiments, assaying the expression level of a plurality of biomarker genes comprises amplifying a plurality of target nucleic acids. In some embodiments, assaying the expression level of a plurality of biomarker genes comprises conducting a multiplexed reaction on a plurality of target analytes.

The methods disclosed herein often comprise assaying the expression level of a plurality of targets. The plurality of targets may comprise coding targets and/or non-coding targets of a protein-coding gene or a non-protein-coding gene. A protein-coding gene structure may comprise an exon and an intron. The exon may further comprise a coding sequence (CDS) and an untranslated region (UTR). The protein-coding gene may be transcribed to produce a pre-mRNA and the pre-mRNA may be processed to produce a mature mRNA. The mature mRNA may be translated to produce a protein.

A non-protein-coding gene structure may comprise an exon and intron. Usually, the exon region of a non-protein-coding gene primarily contains a UTR. The non-protein-coding gene may be transcribed to produce a pre-mRNA and the pre-mRNA may be processed to produce a non-coding RNA (ncRNA).

A coding target may comprise a coding sequence of an exon. A non-coding target may comprise a UTR sequence of an exon, intron sequence, intergenic sequence, promoter sequence, non-coding transcript, CDS antisense, intronic antisense, UTR antisense, or non-coding transcript antisense. A non-coding transcript may comprise a non-coding RNA (ncRNA).

In some instances, the plurality of targets comprises one or more targets selected from Table 3, Table 5, Table 13 or SEQ ID Nos: 1-4050. In some instances, the plurality of targets comprises at least about 2, at least about 3, at least about 4, at least about 5, at least about 6, at least about 7, at least about 8, at least about 9, at least about 10, at least about 15, at least about 20, at least about 25, at least about 30, at least about 35, at least about 40, at least about 45, or at least about 50 targets selected from Table 3, Table 5, Table 13 or SEQ ID Nos: 1-4050.

In some instances, the plurality of targets comprises one or more targets selected from CPSF6 and ELF3; CPSF6 and PTPN13; CPSF6 and SNCG; CPSF6 and VGLL1; CPSF6, PTPN13 and ELF3; CPSF6, PTPN13 and SNCG; CPSF6, PTPN13 and VGLL1; CPSF6, PTPN13, VGLL1 and ELF3; CPSF6, PTPN13, VGLL1 and SNCG; CPSF6, PTPN13, VGLL1, ELF3 and SNCG; CPSF6; EFEMP1 and CPSF6; EFEMP1 and ELF3; EFEMP1 and PTPN13; EFEMP1 and PTPRM; EFEMP1 and SNCG; EFEMP1 and VGLL1; EFEMP1, PTPRM and CPSF6; EFEMP1, PTPRM and ELF3; EFEMP1, PTPRM and PTPN13; EFEMP1, PTPRM and SNCG; EFEMP1, PTPRM and VGLL1; EFEMP1, PTPRM, CPSF6 and ELF3; EFEMP1, PTPRM, CPSF6 and PTPN13; EFEMP1, PTPRM, CPSF6 and SNCG; EFEMP1, PTPRM, CPSF6 and VGLL1; EFEMP1, PTPRM, CPSF6, PTPN13 and ELF3; EFEMP1, PTPRM, CPSF6, PTPN13 and SNCG; EFEMP1, PTPRM, CPSF6, PTPN13 and VGLL1; EFEMP1, PTPRM, CPSF6, PTPN13, VGLL1 and ELF3; EFEMP1, PTPRM, CPSF6, PTPN13, VGLL1 and SNCG; EFEMP1, PTPRM, CPSF6, PTPN13, VGLL1, ELF3 and SNCG; EFEMP1; ELF3 and SNCG; ELF3; GABRP and CPSF6; GABRP and EFEMP1; GABRP and ELF3; GABRP and PTPN13; GABRP and PTPRM; GABRP and SNCG; GABRP and VGLL1; GABRP and EFEMP1; GABRP, EFEMP1 and CPSF6; GABRP, EFEMP1 and ELF3; GABRP, EFEMP1 and PTPN13; GABRP, EFEMP1 and PTPRM; GABRP, EFEMP1 and SNCG; GABRP, EFEMP1 and VGLL1; GABRP, EFEMP1, PTPRM and CPSF6; GABRP, EFEMP1, PTPRM and ELF3; GABRP, EFEMP1, PTPRM and PTPN13; GABRP, EFEMP1, PTPRM and SNCG; GABRP, EFEMP1, PTPRM and VGLL1; GABRP, EFEMP1, PTPRM, CPSF6 and ELF3; GABRP, EFEMP1, PTPRM, CPSF6 and PTPN13; GABRP, EFEMP1, PTPRM, CPSF6 and SNCG; GABRP, EFEMP1, PTPRM, CPSF6 and VGLL1; GABRP, EFEMP1, PTPRM, CPSF6, PTPN13 and ELF3; GABRP, EFEMP1, PTPRM, CPSF6, PTPN13 and SNCG; GABRP, EFEMP1, PTPRM, CPSF6, PTPN13 and VGLL1; GABRP, EFEMP1, PTPRM, CPSF6, PTPN13, VGLL1 and ELF3; GABRP, EFEMP1, PTPRM, CPSF6, PTPN13, VGLL1 and SNCG; GABRP, EFEMP1, PTPRM, CPSF6, PTPN13, VGLL1, ELF3 and SNCG; GABRP; GBP1 and CPSF6; GBP1 and EFEMP1; GBP1 and ELF3; GBP1 and GABRP; GBP1 and PTPN13; GBP1 and PTPRM; GBP1 and SNAI2; GBP1 and SNCG; GBP1 and TMEM45A; GBP1 and VGLL1; GBP1, SNAI2 and CPSF6; GBP1, SNAI2 and EFEMP1; GBP1, SNAI2 and ELF3; GBP1, SNAI2 and GABRP; GBP1, SNAI2 and PTPN13; GBP1, SNAI2 and PTPRM; GBP1, SNAI2 and SNCG; GBP1, SNAI2 and TMEM45A; GBP1, SNAI2 and VGLL1; GBP1, SNAI2, TMEM45A and CPSF6; GBP1, SNAI2, TMEM45A and EFEMP1; GBP1, SNAI2, TMEM45A and ELF3; GBP1, SNAI2, TMEM45A and GABRP; GBP1, SNAI2, TMEM45A and PTPN13; GBP1, SNAI2, TMEM45A and PTPRM; GBP1, SNAI2, TMEM45A and SNCG; GBP1, SNAI2, TMEM45A and VGLL1; GBP1, SNAI2, TMEM45A, GABRP and CPSF6; GBP1, SNAI2, TMEM45A, GABRP and EFEMP1; GBP1, SNAI2, TMEM45A, GABRP and ELF3; GBP1, SNAI2, TMEM45A, GABRP and PTPN13; GBP1, SNAI2, TMEM45A, GABRP and PTPRM; GBP1, SNAI2, TMEM45A, GABRP and SNCG; GBP1, SNAI2, TMEM45A, GABRP and VGLL1; GBP1, SNAI2, TMEM45A, GABRP, EFEMP1 and CPSF6; GBP1, SNAI2, TMEM45A, GABRP, EFEMP1 and ELF3; GBP1, SNAI2, TMEM45A, GABRP, EFEMP1 and PTPN13; GBP1, SNAI2, TMEM45A, GABRP, EFEMP1 and PTPRM; GBP1, SNAI2, TMEM45A, GABRP, EFEMP1 and SNCG; GBP1, SNAI2, TMEM45A, GABRP, EFEMP1 and VGLL1; GBP1, SNAI2, TMEM45A, GABRP, EFEMP1, PTPRM and CPSF6; GBP1, SNAI2, TMEM45A, GABRP, EFEMP1, PTPRM and ELF3; GBP1, SNAI2, TMEM45A, GABRP, EFEMP1, PTPRM and PTPN13; GBP1, SNAI2, TMEM45A, GABRP, EFEMP1, PTPRM and SNCG; GBP1, SNAI2, TMEM45A, GABRP, EFEMP1, PTPRM and VGLL1; GBP1, SNAI2, TMEM45A, GABRP, EFEMP1, PTPRM, CPSF6 and ELF3; GBP1, SNAI2, TMEM45A, GABRP, EFEMP1, PTPRM, CPSF6 and PTPN13; GBP1, SNAI2, TMEM45A, GABRP, EFEMP1, PTPRM, CPSF6 and SNCG; GBP1, SNAI2, TMEM45A, GABRP, EFEMP1, PTPRM, CPSF6 and VGLL1; GBP1, SNAI2, TMEM45A, GABRP, EFEMP1, PTPRM, CPSF6, PTPN13 and ELF3; GBP1, SNAI2, TMEM45A, GABRP, EFEMP1, PTPRM, CPSF6, PTPN13 and SNCG; GBP1, SNAI2, TMEM45A, GABRP, EFEMP1, PTPRM, CPSF6, PTPN13 and VGLL1; GBP1, SNAI2, TMEM45A, GABRP, EFEMP1, PTPRM, CPSF6, PTPN13, VGLL1 and ELF3; GBP1, SNAI2, TMEM45A, GABRP, EFEMP1, PTPRM, CPSF6, PTPN13, VGLL1 and SNCG; GBP1, SNAI2, TMEM45A, GABRP, EFEMP1, PTPRM, CPSF6, PTPN13, VGLL1, ELF3 and SNCG; GBP1; IFI30 and CPSF6; IFI30 and EFEMP1; IFI30 and ELF3; IFI30 and GABRP; IFI30 and GBP1; IFI30 and PTPN13; IFI30 and PTPRM; IFI30 and SAA1; IFI30 and SNAI2; IFI30 and SNCG; IFI30 and TGFBI; IFI30 and TIMP2; IFI30 and TMEM45A; IFI30 and VGLL1; IFI30 and VIM; IFI30, SAA1 and CPSF6; IFI30, SAA1 and EFEMP1; IFI30, SAA1 and ELF3; IFI30, SAA1 and GABRP; IFI30, SAA1 and GBP1; IFI30, SAA1 and PTPN13; IFI30, SAA1 and PTPRM; IFI30, SAA1 and SNAI2; IFI30, SAA1 and SNCG; IFI30, SAA1 and TGFBI; IFI30, SAA1 and TIMP2; IFI30, SAA1 and TMEM45A; IFI30, SAA1 and VGLL1; IFI30, SAA1 and VIM; IFI30, SAA1, VIM and CPSF6; IFI30, SAA1, VIM and EFEMP1; IFI30, SAA1, VIM and ELF3; IFI30, SAA1, VIM and GABRP; IFI30, SAA1, VIM and GBP1; IFI30, SAA1, VIM and PTPN13; IFI30, SAA1, VIM and PTPRM; IFI30, SAA1, VIM and SNAI2; IFI30, SAA1, VIM and SNCG; IFI30, SAA1, VIM and TGFBI; IFI30, SAA1, VIM and TIMP2; IFI30, SAA1, VIM and TMEM45A; IFI30, SAA1, VIM and VGLL1; IFI30, SAA1, VIM, TGFBI and CPSF6; IFI30, SAA1, VIM, TGFBI and EFEMP1; IFI30, SAA1, VIM, TGFBI and ELF3; IFI30, SAA1, VIM, TGFBI and GABRP; IFI30, SAA1, VIM, TGFBI and GBP1; IFI30, SAA1, VIM, TGFBI and PTPN13; IFI30, SAA1, VIM, TGFBI and PTPRM; IFI30, SAA1, VIM, TGFBI and SNAI2; IFI30, SAA1, VIM, TGFBI and SNCG; IFI30, SAA1, VIM, TGFBI and TIMP2; IFI30, SAA1, VIM, TGFBI and TMEM45A; IFI30, SAA1, VIM, TGFBI and VGLL1; IFI30, SAA1, VIM, TGFBI, TIMP2 and CPSF6; IFI30, SAA1, VIM, TGFBI, TIMP2 and EFEMP1; IFI30, SAA1, VIM, TGFBI, TIMP2 and ELF3; IFI30, SAA1, VIM, TGFBI, TIMP2 and GABRP; IFI30, SAA1, VIM, TGFBI, TIMP2 and GBP1; IFI30, SAA1, VIM, TGFBI, TIMP2 and PTPN13; IFI30, SAA1, VIM, TGFBI, TIMP2 and PTPRM; IFI30, SAA1, VIM, TGFBI, TIMP2 and SNAI2; IFI30, SAA1, VIM, TGFBI, TIMP2 and SNCG; IFI30, SAA1, VIM, TGFBI, TIMP2 and TMEM45A; IFI30, SAA1, VIM, TGFBI, TIMP2 and VGLL1; IFI30, SAA1, VIM, TGFBI, TIMP2, GBP1 and CPSF6; IFI30, SAA1, VIM, TGFBI, TIMP2, GBP1 and EFEMP1; IFI30, SAA1, VIM, TGFBI, TIMP2, GBP1 and ELF3; IFI30, SAA1, VIM, TGFBI, TIMP2, GBP1 and GABRP; IFI30, SAA1, VIM, TGFBI, TIMP2, GBP1 and PTPN13; IFI30, SAA1, VIM, TGFBI, TIMP2, GBP1 and PTPRM; IFI30, SAA1, VIM, TGFBI, TIMP2, GBP1 and SNAI2; IFI30, SAA1, VIM, TGFBI, TIMP2, GBP1 and SNCG; IFI30, SAA1, VIM, TGFBI, TIMP2, GBP1 and TMEM45A; IFI30, SAA1, VIM, TGFBI, TIMP2, GBP1 and VGLL1; IFI30, SAA1, VIM, TGFBI, TIMP2, GBP1, SNAI2 and CPSF6; IFI30, SAA1, VIM, TGFBI, TIMP2, GBP1, SNAI2 and EFEMP1; IFI30, SAA1, VIM, TGFBI, TIMP2, GBP1, SNAI2 and ELF3; IFI30, SAA1, VIM, TGFBI, TIMP2, GBP1, SNAI2 and GABRP; IFI30, SAA1, VIM, TGFBI, TIMP2, GBP1, SNAI2 and PTPN13; IFI30, SAA1, VIM, TGFBI, TIMP2, GBP1, SNAI2 and PTPRM; IFI30, SAA1, VIM, TGFBI, TIMP2, GBP1, SNAI2 and SNCG; IFI30, SAA1, VIM, TGFBI, TIMP2, GBP1, SNAI2 and TMEM45A; IFI30, SAA1, VIM, TGFBI, TIMP2, GBP1, SNAI2 and VGLL1; IFI30, SAA1, VIM, TGFBI, TIMP2, GBP1, SNAI2, TMEM45A and CPSF6; IFI30, SAA1, VIM, TGFBI, TIMP2, GBP1, SNAI2, TMEM45A and EFEMP1; IFI30, SAA1, VIM, TGFBI, TIMP2, GBP1, SNAI2, TMEM45A and ELF3; IFI30, SAA1, VIM, TGFBI, TIMP2, GBP1, SNAI2, TMEM45A and GABRP; IFI30, SAA1, VIM, TGFBI, TIMP2, GBP1, SNAI2, TMEM45A and PTPN13; IFI30, SAA1, VIM, TGFBI, TIMP2, GBP1, SNAI2, TMEM45A and PTPRM; IFI30, SAA1, VIM, TGFBI, TIMP2, GBP1, SNAI2, TMEM45A and SNCG; IFI30, SAA1, VIM, TGFBI, TIMP2, GBP1, SNAI2, TMEM45A and VGLL1; IFI30, SAA1, VIM, TGFBI, TIMP2, GBP1, SNAI2, TMEM45A, GABRP and CPSF6; IFI30, SAA1, VIM, TGFBI, TIMP2, GBP1, SNAI2, TMEM45A, GABRP and EFEMP1; IFI30, SAA1, VIM, TGFBI, TIMP2, GBP1, SNAI2, TMEM45A, GABRP and ELF3; IFI30, SAA1, VIM, TGFBI, TIMP2, GBP1, SNAI2, TMEM45A, GABRP and PTPRM; IFI30, SAA1, VIM, TGFBI, TIMP2, GBP1, SNAI2, TMEM45A, GABRP and PTPN13; IFI30, SAA1, VIM, TGFBI, TIMP2, GBP1, SNAI2, TMEM45A, GABRP and SNCG; IFI30, SAA1, VIM, TGFBI, TIMP2, GBP1, SNAI2, TMEM45A, GABRP and VGLL1; IFI30, SAA1, VIM, TGFBI, TIMP2, GBP1, SNAI2, TMEM45A, GABRP, EFEMP1 and PTPRM; IFI30, SAA1, VIM, TGFBI, TIMP2, GBP1, SNAI2, TMEM45A, GABRP, EFEMP1 and CPSF6; IFI30, SAA1, VIM, TGFBI, TIMP2, GBP1, SNAI2, TMEM45A, GABRP, EFEMP1 and PTPN13; IFI30, SAA1, VIM, TGFBI, TIMP2, GBP1, SNAI2, TMEM45A, GABRP, EFEMP1 and VGLL1; IFI30, SAA1, VIM, TGFBI, TIMP2, GBP1, SNAI2, TMEM45A, GABRP, EFEMP1 and ELF3; IFI30, SAA1, VIM, TGFBI, TIMP2, GBP1, SNAI2, TMEM45A, GABRP, EFEMP1 and SNCG; IFI30, SAA1, VIM, TGFBI, TIMP2, GBP1, SNAI2, TMEM45A, GABRP, EFEMP1, PTPRM and CPSF6; IFI30, SAA1, VIM, TGFBI, TIMP2, GBP1, SNAI2, TMEM45A, GABRP, EFEMP1, PTPRM and PTPN13; IFI30, SAA1, VIM, TGFBI, TIMP2, GBP1, SNAI2, TMEM45A, GABRP, EFEMP1, PTPRM and VGLL1; IFI30, SAA1, VIM, TGFBI, TIMP2, GBP1, SNAI2, TMEM45A, GABRP, EFEMP1, PTPRM and ELF3; IFI30, SAA1, VIM, TGFBI, TIMP2, GBP1, SNAI2, TMEM45A, GABRP, EFEMP1, PTPRM and SNCG; IFI30, SAA1, VIM, TGFBI, TIMP2, GBP1, SNAI2, TMEM45A, GABRP, EFEMP1, PTPRM, CPSF6 and PTPN13; IFI30, SAA1, VIM, TGFBI, TIMP2, GBP1, SNAI2, TMEM45A, GABRP, EFEMP1, PTPRM, CPSF6 and VGLL1; IFI30, SAA1, VIM, TGFBI, TIMP2, GBP1, SNAI2, TMEM45A, GABRP, EFEMP1, PTPRM, CPSF6 and ELF3; IFI30, SAA1, VIM, TGFBI, TIMP2, GBP1, SNAI2, TMEM45A, GABRP, EFEMP1, PTPRM, CPSF6 and SNCG; IFI30, SAA1, VIM, TGFBI, TIMP2, GBP1, SNAI2, TMEM45A, GABRP, EFEMP1, PTPRM, CPSF6, PTPN13 and VGLL1; IFI30, SAA1, VIM, TGFBI, TIMP2, GBP1, SNAI2, TMEM45A, GABRP, EFEMP1, PTPRM, CPSF6, PTPN13 and ELF3; IFI30, SAA1, VIM, TGFBI, TIMP2, GBP1, SNAI2, TMEM45A, GABRP, EFEMP1, PTPRM, CPSF6, PTPN13 and SNCG; IFI30, SAA1, VIM, TGFBI, TIMP2, GBP1, SNAI2, TMEM45A, GABRP, EFEMP1, PTPRM, CPSF6, PTPN13, VGLL1 and ELF3; IFI30, SAA1, VIM, TGFBI, TIMP2, GBP1, SNAI2, TMEM45A, GABRP, EFEMP1, PTPRM, CPSF6, PTPN13, VGLL1 and SNCG;

IFI30, SAA1, VIM, TGFBI, TIMP2, GBP1, SNAI2, TMEM45A, GABRP, EFEMP1, PTPRM, CPSF6, PTPN13, VGLL1, ELF3 and SNCG; IFI30; LAMC2 and CPSF6; LAMC2 and EFEMP1; LAMC2 and ELF3; LAMC2 and GABRP; LAMC2 and GBP1; LAMC2 and IFI30; LAMC2 and PTPN13; LAMC2 and PTPRM; LAMC2 and SAA1; LAMC2 and SNAI2; LAMC2 and SNCG; LAMC2 and TGFBI; LAMC2 and TIMP2; LAMC2 and TMEM45A; LAMC2 and VGLL1; LAMC2 and VIM; LAMC2, IFI30 and CPSF6; LAMC2, IFI30 and EFEMP1; LAMC2, IFI30 and ELF3; LAMC2, IFI30 and GABRP; LAMC2, IFI30 and GBP1; LAMC2, IFI30 and PTPN13; LAMC2, IFI30 and PTPRM; LAMC2, IFI30 and SAA1; LAMC2, IFI30 and SNAI2; LAMC2, IFI30 and SNCG; LAMC2, IFI30 and TGFBI; LAMC2, IFI30 and TIMP2; LAMC2, IFI30 and TMEM45A; LAMC2, IFI30 and VGLL1; LAMC2, IFI30 and VIM; LAMC2, IFI30, SAA1 and CPSF6; LAMC2, IFI30, SAA1 and EFEMP1; LAMC2, IFI30, SAA1 and ELF3; LAMC2, IFI30, SAA1 and GABRP; LAMC2, IFI30, SAA1 and GBP1; LAMC2, IFI30, SAA1 and PTPN13; LAMC2, IFI30, SAA1 and PTPRM; LAMC2, IFI30, SAA1 and SNAI2; LAMC2, IFI30, SAA1 and SNCG; LAMC2, IFI30, SAA1 and TGFBI; LAMC2, IFI30, SAA1 and TIMP2; LAMC2, IFI30, SAA1 and TMEM45A; LAMC2, IFI30, SAA1 and VGLL1; LAMC2, IFI30, SAA1 and VIM; LAMC2, IFI30, SAA1, VIM and CPSF6; LAMC2, IFI30, SAA1, VIM and EFEMP1; LAMC2, IFI30, SAA1, VIM and ELF3; LAMC2, IFI30, SAA1, VIM and GABRP; LAMC2, IFI30, SAA1, VIM and GBP1; LAMC2, IFI30, SAA1, VIM and PTPN13; LAMC2, IFI30, SAA1, VIM and PTPRM; LAMC2, IFI30, SAA1, VIM and SNAI2; LAMC2, IFI30, SAA1, VIM and SNCG; LAMC2, IFI30, SAA1, VIM and TGFBI; LAMC2, IFI30, SAA1, VIM and TIMP2; LAMC2, IFI30, SAA1, VIM and TMEM45A; LAMC2, IFI30, SAA1, VIM and VGLL1; LAMC2, IFI30, SAA1, VIM, TGFBI and CPSF6; LAMC2, IFI30, SAA1, VIM, TGFBI and EFEMP1; LAMC2, IFI30, SAA1, VIM, TGFBI and ELF3; LAMC2, IFI30, SAA1, VIM, TGFBI and GABRP; LAMC2, IFI30, SAA1, VIM, TGFBI and GBP1; LAMC2, IFI30, SAA1, VIM, TGFBI and PTPN13; LAMC2, IFI30, SAA1, VIM, TGFBI and PTPRM; LAMC2, IFI30, SAA1, VIM, TGFBI and SNAI2; LAMC2, IFI30, SAA1, VIM, TGFBI and SNCG; LAMC2, IFI30, SAA1, VIM, TGFBI and TIMP2; LAMC2, IFI30, SAA1, VIM, TGFBI and TMEM45A; LAMC2, IFI30, SAA1, VIM, TGFBI and VGLL1; LAMC2, IFI30, SAA1, VIM, TGFBI, TIMP2 and CPSF6; LAMC2, IFI30, SAA1, VIM, TGFBI, TIMP2 and EFEMP1; LAMC2, IFI30, SAA1, VIM, TGFBI, TIMP2 and ELF3; LAMC2, IFI30, SAA1, VIM, TGFBI, TIMP2 and GABRP; LAMC2, IFI30, SAA1, VIM, TGFBI, TIMP2 and GBP1; LAMC2, IFI30, SAA1, VIM, TGFBI, TIMP2 and PTPN13; LAMC2, IFI30, SAA1, VIM, TGFBI, TIMP2 and PTPRM; LAMC2, IFI30, SAA1, VIM, TGFBI, TIMP2 and SNAI2; LAMC2, IFI30, SAA1, VIM, TGFBI, TIMP2 and SNCG; LAMC2, IFI30, SAA1, VIM, TGFBI, TIMP2 and TMEM45A; LAMC2, IFI30, SAA1, VIM, TGFBI, TIMP2 and VGLL1; LAMC2, IFI30, SAA1, VIM, TGFBI, TIMP2, GBP1 and CPSF6; LAMC2, IFI30, SAA1, VIM, TGFBI, TIMP2, GBP1 and EFEMP1; LAMC2, IFI30, SAA1, VIM, TGFBI, TIMP2, GBP1 and ELF3; LAMC2, IFI30, SAA1, VIM, TGFBI, TIMP2, GBP1 and GABRP; LAMC2, IFI30, SAA1, VIM, TGFBI, TIMP2, GBP1 and PTPN13; LAMC2, IFI30, SAA1, VIM, TGFBI, TIMP2, GBP1 and PTPRM; LAMC2, IFI30, SAA1, VIM, TGFBI, TIMP2, GBP1 and SNAI2; LAMC2, IFI30, SAA1, VIM, TGFBI, TIMP2, GBP1 and SNCG; LAMC2, IFI30, SAA1, VIM, TGFBI, TIMP2, GBP1 and TMEM45A; LAMC2, IFI30, SAA1, VIM, TGFBI, TIMP2, GBP1 and VGLL1; LAMC2, IFI30, SAA1, VIM, TGFBI, TIMP2, GBP1, SNAI2 and CPSF6; LAMC2, IFI30, SAA1, VIM, TGFBI, TIMP2, GBP1, SNAI2 and EFEMP1; LAMC2, IFI30, SAA1, VIM, TGFBI, TIMP2, GBP1, SNAI2 and ELF3; LAMC2, IFI30, SAA1, VIM, TGFBI, TIMP2, GBP1, SNAI2 and GABRP; LAMC2, IFI30, SAA1, VIM, TGFBI, TIMP2, GBP1, SNAI2 and PTPN13; LAMC2, IFI30, SAA1, VIM, TGFBI, TIMP2, GBP1, SNAI2 and PTPRM; LAMC2, IFI30, SAA1, VIM, TGFBI, TIMP2, GBP1, SNAI2 and SNCG; LAMC2, IFI30, SAA1, VIM, TGFBI, TIMP2, GBP1, SNAI2 and TMEM45A; LAMC2, IFI30, SAA1, VIM, TGFBI, TIMP2, GBP1, SNAI2 and VGLL1; LAMC2, IFI30, SAA1, VIM, TGFBI, TIMP2, GBP1, SNAI2, TMEM45A and CPSF6; LAMC2, IFI30, SAA1, VIM, TGFBI, TIMP2, GBP1, SNAI2, TMEM45A and EFEMP1; LAMC2, IFI30, SAA1, VIM, TGFBI, TIMP2, GBP1, SNAI2, TMEM45A and ELF3; LAMC2, IFI30, SAA1, VIM, TGFBI, TIMP2, GBP1, SNAI2, TMEM45A and GABRP; LAMC2, IFI30, SAA1, VIM, TGFBI, TIMP2, GBP1, SNAI2, TMEM45A and PTPRM; LAMC2, IFI30, SAA1, VIM, TGFBI, TIMP2, GBP1, SNAI2, TMEM45A and PTPN13; LAMC2, IFI30, SAA1, VIM, TGFBI, TIMP2, GBP1, SNAI2, TMEM45A and SNCG; LAMC2, IFI30, SAA1, VIM, TGFBI, TIMP2, GBP1, SNAI2, TMEM45A and VGLL1; LAMC2, IFI30, SAA1, VIM, TGFBI, TIMP2, GBP1, SNAI2, TMEM45A, GABRP and EFEMP1; LAMC2, IFI30, SAA1, VIM, TGFBI, TIMP2, GBP1, SNAI2, TMEM45A, GABRP and PTPRM; LAMC2, IFI30, SAA1, VIM, TGFBI, TIMP2, GBP1, SNAI2, TMEM45A, GABRP and CPSF6; LAMC2, IFI30, SAA1, VIM, TGFBI, TIMP2, GBP1, SNAI2, TMEM45A, GABRP and PTPN13; LAMC2, IFI30, SAA1, VIM, TGFBI, TIMP2, GBP1, SNAI2, TMEM45A, GABRP and VGLL1; LAMC2, IFI30, SAA1, VIM, TGFBI, TIMP2, GBP1, SNAI2, TMEM45A, GABRP and ELF3; LAMC2, IFI30, SAA1, VIM, TGFBI, TIMP2, GBP1, SNAI2, TMEM45A, GABRP and SNCG; LAMC2, IFI30, SAA1, VIM, TGFBI, TIMP2, GBP1, SNAI2, TMEM45A, GABRP, EFEMP1 and PTPRM; LAMC2, IFI30, SAA1, VIM, TGFBI, TIMP2, GBP1, SNAI2, TMEM45A, GABRP, EFEMP1 and CPSF6; LAMC2, IFI30, SAA1, VIM, TGFBI, TIMP2, GBP1, SNAI2, TMEM45A, GABRP, EFEMP1 and PTPN13; LAMC2, IFI30, SAA1, VIM, TGFBI, TIMP2, GBP1, SNAI2, TMEM45A, GABRP, EFEMP1 and VGLL1; LAMC2, IFI30, SAA1, VIM, TGFBI, TIMP2, GBP1, SNAI2, TMEM45A, GABRP, EFEMP1 and ELF3; LAMC2, IFI30, SAA1, VIM, TGFBI, TIMP2, GBP1, SNAI2, TMEM45A, GABRP, EFEMP1 and SNCG; LAMC2, IFI30, SAA1, VIM, TGFBI, TIMP2, GBP1, SNAI2, TMEM45A, GABRP, EFEMP1, PTPRM and CPSF6; LAMC2, IFI30, SAA1, VIM, TGFBI, TIMP2, GBP1, SNAI2, TMEM45A, GABRP, EFEMP1, PTPRM and PTPN13; LAMC2, IFI30, SAA1, VIM, TGFBI, TIMP2, GBP1, SNAI2, TMEM45A, GABRP, EFEMP1, PTPRM and VGLL1; LAMC2, IFI30, SAA1, VIM, TGFBI, TIMP2, GBP1, SNAI2, TMEM45A, GABRP, EFEMP1, PTPRM and ELF3; LAMC2, IFI30, SAA1, VIM, TGFBI, TIMP2, GBP1, SNAI2, TMEM45A, GABRP, EFEMP1, PTPRM and SNCG; LAMC2, IFI30, SAA1, VIM, TGFBI, TIMP2, GBP1, SNAI2, TMEM45A, GABRP, EFEMP1, PTPRM, CPSF6 and PTPN13; LAMC2, IFI30, SAA1, VIM, TGFBI, TIMP2, GBP1, SNAI2, TMEM45A, GABRP, EFEMP1, PTPRM, CPSF6 and VGLL1; LAMC2, IFI30, SAA1, VIM, TGFBI, TIMP2, GBP1, SNAI2, TMEM45A, GABRP, EFEMP1, PTPRM, CPSF6 and ELF3; LAMC2, IFI30, SAA1, VIM, TGFBI, TIMP2, GBP1, SNAI2, TMEM45A, GABRP, EFEMP1, PTPRM, CPSF6 and SNCG; LAMC2, IFI30, SAA1, VIM, TGFBI, TIMP2, GBP1, SNAI2, TMEM45A, GABRP, EFEMP1, PTPRM, CPSF6, PTPN13 and VGLL1; LAMC2, IFI30, SAA1, VIM, TGFBI, TIMP2, GBP1, SNAI2, TMEM45A, GABRP, EFEMP1, PTPRM, CPSF6, PTPN13 and ELF3; LAMC2, IFI30, SAA1, VIM, TGFBI, TIMP2, GBP1, SNAI2, TMEM45A, GABRP, EFEMP1, PTPRM, CPSF6, PTPN13 and SNCG; LAMC2, IFI30, SAA1, VIM, TGFBI, TIMP2, GBP1, SNAI2, TMEM45A, GABRP, EFEMP1, PTPRM, CPSF6, PTPN13, VGLL1 and ELF3; LAMC2, IFI30, SAA1, VIM, TGFBI, TIMP2, GBP1, SNAI2, TMEM45A, GABRP, EFEMP1, PTPRM, CPSF6, PTPN13, VGLL1 and SNCG; LAMC2, IFI30, SAA1, VIM, TGFBI, TIMP2, GBP1, SNAI2, TMEM45A, GABRP, EFEMP1, PTPRM, CPSF6, PTPN13, VGLL1, ELF3 and SNCG; LAMC2; PTPN13 and ELF3; PTPN13 and SNCG; PTPN13 and VGLL1; PTPN13, VGLL1 and ELF3; PTPN13, VGLL1 and SNCG; PTPN13, VGLL1, ELF3 and SNCG; PTPN13; PTPRM and CPSF6; PTPRM and ELF3; PTPRM and PTPN13; PTPRM and SNCG; PTPRM and VGLL1; PTPRM, CPSF6 and ELF3; PTPRM, CPSF6 and PTPN13; PTPRM, CPSF6 and SNCG; PTPRM, CPSF6 and VGLL1; PTPRM, CPSF6, PTPN13 and ELF3; PTPRM, CPSF6, PTPN13 and SNCG; PTPRM, CPSF6, PTPN13 and VGLL1; PTPRM, CPSF6, PTPN13, VGLL1 and ELF3; PTPRM, CPSF6, PTPN13, VGLL1 and SNCG; PTPRM, CPSF6, PTPN13, VGLL1, ELF3 and SNCG; PTPRM; SAA1 and CPSF6; SAA1 and EFEMP1; SAA1 and ELF3; SAA1 and GABRP; SAA1 and GBP1; SAA1 and PTPN13; SAA1 and PTPRM; SAA1 and SNAI2; SAA1 and SNCG; SAA1 and TGFBI; SAA1 and TIMP2; SAA1 and TMEM45A; SAA1 and VGLL1; SAA1 and VIM; SAA1, VIM and CPSF6; SAA1, VIM and EFEMP1; SAA1, VIM and ELF3; SAA1, VIM and GABRP; SAA1, VIM and GBP1; SAA1, VIM and PTPN13; SAA1, VIM and PTPRM; SAA1, VIM and SNAI2; SAA1, VIM and SNCG; SAA1, VIM and TGFBI; SAA1, VIM and TIMP2; SAA1, VIM and TMEM45A; SAA1, VIM and VGLL1; SAA1, VIM, TGFBI and CPSF6; SAA1, VIM, TGFBI and EFEMP1; SAA1, VIM, TGFBI and ELF3; SAA1, VIM, TGFBI and GABRP; SAA1, VIM, TGFBI and GBP1; SAA1, VIM, TGFBI and PTPN13; SAA1, VIM, TGFBI and PTPRM; SAA1, VIM, TGFBI and SNAI2; SAA1, VIM, TGFBI and SNCG; SAA1, VIM, TGFBI and TIMP2; SAA1, VIM, TGFBI and TMEM45A; SAA1, VIM, TGFBI and VGLL1; SAA1, VIM, TGFBI, TIMP2 and CPSF6; SAA1, VIM, TGFBI, TIMP2 and EFEMP1; SAA1, VIM, TGFBI, TIMP2 and ELF3; SAA1, VIM, TGFBI, TIMP2 and GABRP; SAA1, VIM, TGFBI, TIMP2 and GBP1; SAA1, VIM, TGFBI, TIMP2 and PTPN13; SAA1, VIM, TGFBI, TIMP2 and PTPRM; SAA1, VIM, TGFBI, TIMP2 and SNAI2; SAA1, VIM, TGFBI, TIMP2 and SNCG; SAA1, VIM, TGFBI, TIMP2 and TMEM45A; SAA1, VIM, TGFBI, TIMP2 and VGLL1; SAA1, VIM, TGFBI, TIMP2, GBP1 and CPSF6; SAA1, VIM, TGFBI, TIMP2, GBP1 and EFEMP1; SAA1, VIM, TGFBI, TIMP2, GBP1 and ELF3; SAA1, VIM, TGFBI, TIMP2, GBP1 and GABRP; SAA1, VIM, TGFBI, TIMP2, GBP1 and PTPN13; SAA1, VIM, TGFBI, TIMP2, GBP1 and PTPRM; SAA1, VIM, TGFBI, TIMP2, GBP1 and SNAI2; SAA1, VIM, TGFBI, TIMP2, GBP1 and SNCG; SAA1, VIM, TGFBI, TIMP2, GBP1 and TMEM45A; SAA1, VIM, TGFBI, TIMP2, GBP1 and VGLL1; SAA1, VIM, TGFBI, TIMP2, GBP1, SNAI2 and CPSF6; SAA1, VIM, TGFBI, TIMP2, GBP1, SNAI2 and EFEMP1; SAA1, VIM, TGFBI, TIMP2, GBP1, SNAI2 and ELF3; SAA1, VIM, TGFBI, TIMP2, GBP1, SNAI2 and GABRP; SAA1, VIM, TGFBI, TIMP2, GBP1, SNAI2 and PTPN13; SAA1, VIM, TGFBI, TIMP2, GBP1, SNAI2 and PTPRM; SAA1, VIM, TGFBI, TIMP2, GBP1, SNAI2 and SNCG; SAA1, VIM, TGFBI, TIMP2, GBP1, SNAI2 and TMEM45A; SAA1, VIM, TGFBI, TIMP2, GBP1, SNAI2 and VGLL1; SAA1, VIM, TGFBI, TIMP2, GBP1, SNAI2, TMEM45A and CPSF6; SAA1, VIM, TGFBI, TIMP2, GBP1, SNAI2, TMEM45A and EFEMP1; SAA1, VIM, TGFBI, TIMP2, GBP1, SNAI2, TMEM45A and ELF3; SAA1, VIM, TGFBI, TIMP2, GBP1, SNAI2, TMEM45A and GABRP; SAA1, VIM, TGFBI, TIMP2, GBP1, SNAI2, TMEM45A and PTPN13; SAA1, VIM, TGFBI, TIMP2, GBP1, SNAI2, TMEM45A and PTPRM; SAA1, VIM, TGFBI, TIMP2, GBP1, SNAI2, TMEM45A and SNCG; SAA1, VIM, TGFBI, TIMP2, GBP1, SNAI2, TMEM45A and VGLL1; SAA1, VIM, TGFBI, TIMP2, GBP1, SNAI2, TMEM45A, GABRP and CPSF6; SAA1, VIM, TGFBI, TIMP2, GBP1, SNAI2, TMEM45A, GABRP and EFEMP1; SAA1, VIM, TGFBI, TIMP2, GBP1, SNAI2, TMEM45A, GABRP and ELF3; SAA1, VIM, TGFBI, TIMP2, GBP1, SNAI2, TMEM45A, GABRP and PTPN13; SAA1, VIM, TGFBI, TIMP2, GBP1, SNAI2, TMEM45A, GABRP and PTPRM; SAA1, VIM, TGFBI, TIMP2, GBP1, SNAI2, TMEM45A, GABRP and SNCG; SAA1, VIM, TGFBI, TIMP2, GBP1, SNAI2, TMEM45A, GABRP and VGLL1; SAA1, VIM, TGFBI, TIMP2, GBP1, SNAI2, TMEM45A, GABRP, EFEMP1 and PTPRM; SAA1, VIM, TGFBI, TIMP2, GBP1, SNAI2, TMEM45A, GABRP, EFEMP1 and CPSF6; SAA1, VIM, TGFBI, TIMP2, GBP1, SNAI2, TMEM45A, GABRP, EFEMP1 and PTPN13; SAA1, VIM, TGFBI, TIMP2, GBP1, SNAI2, TMEM45A, GABRP, EFEMP1 and VGLL1; SAA1, VIM, TGFBI, TIMP2, GBP1, SNAI2, TMEM45A, GABRP, EFEMP1 and ELF3; SAA1, VIM, TGFBI, TIMP2, GBP1, SNAI2, TMEM45A, GABRP, EFEMP1 and SNCG; SAA1, VIM, TGFBI, TIMP2, GBP1, SNAI2, TMEM45A, GABRP, EFEMP1, PTPRM and CPSF6; SAA1, VIM, TGFBI, TIMP2, GBP1, SNAI2, TMEM45A, GABRP, EFEMP1, PTPRM and PTPN13; SAA1, VIM, TGFBI, TIMP2, GBP1, SNAI2, TMEM45A, GABRP, EFEMP1, PTPRM and VGLL1; SAA1, VIM, TGFBI, TIMP2, GBP1, SNAI2, TMEM45A, GABRP, EFEMP1, PTPRM and ELF3; SAA1, VIM, TGFBI, TIMP2, GBP1, SNAI2, TMEM45A, GABRP, EFEMP1, PTPRM and SNCG; SAA1, VIM, TGFBI, TIMP2, GBP1, SNAI2, TMEM45A, GABRP, EFEMP1, PTPRM, CPSF6 and PTPN13; SAA1, VIM, TGFBI, TIMP2, GBP1, SNAI2, TMEM45A, GABRP, EFEMP1, PTPRM, CPSF6 and VGLL1; SAA1, VIM, TGFBI, TIMP2, GBP1, SNAI2, TMEM45A, GABRP, EFEMP1, PTPRM, CPSF6 and ELF3; SAA1, VIM, TGFBI, TIMP2, GBP1, SNAI2, TMEM45A, GABRP, EFEMP1, PTPRM, CPSF6 and SNCG; SAA1, VIM, TGFBI, TIMP2, GBP1, SNAI2, TMEM45A, GABRP, EFEMP1, PTPRM, CPSF6, PTPN13 and VGLL1; SAA1, VIM, TGFBI, TIMP2, GBP1, SNAI2, TMEM45A, GABRP, EFEMP1, PTPRM, CPSF6, PTPN13 and ELF3; SAA1, VIM, TGFBI, TIMP2, GBP1, SNAI2, TMEM45A, GABRP, EFEMP1, PTPRM, CPSF6, PTPN13 and SNCG; SAA1, VIM, TGFBI, TIMP2, GBP1, SNAI2, TMEM45A, GABRP, EFEMP1, PTPRM, CPSF6, PTPN13, VGLL1 and ELF3; SAA1, VIM, TGFBI, TIMP2, GBP1, SNAI2, TMEM45A, GABRP, EFEMP1, PTPRM, CPSF6, PTPN13, VGLL1 and SNCG; SAA1, VIM, TGFBI, TIMP2, GBP1, SNAI2, TMEM45A, GABRP, EFEMP1, PTPRM, CPSF6, PTPN13, VGLL1, ELF3 and SNCG; SAA1; SNAI2 and CPSF6; SNAI2 and EFEMP1; SNAI2 and ELF3; SNAI2 and GABRP; SNAI2 and PTPN13; SNAI2 and PTPRM; SNAI2 and SNCG; SNAI2 and TMEM45A; SNAI2 and VGLL1; SNAI2, TMEM45A and CPSF6; SNAI2, TMEM45A and EFEMP1; SNAI2, TMEM45A and ELF3; SNAI2, TMEM45A and GABRP; SNAI2, TMEM45A and PTPN13; SNAI2, TMEM45A and PTPRM; SNAI2, TMEM45A and SNCG; SNAI2, TMEM45A and VGLL1; SNAI2, TMEM45A, GABRP and CPSF6; SNAI2, TMEM45A, GABRP and EFEMP1; SNAI2, TMEM45A, GABRP and ELF3; SNAI2, TMEM45A, GABRP and PTPN13; SNAI2, TMEM45A, GABRP and PTPRM; SNAI2, TMEM45A, GABRP and SNCG; SNAI2, TMEM45A, GABRP and VGLL1; SNAI2, TMEM45A, GABRP, EFEMP1 and CPSF6; SNAI2, TMEM45A, GABRP, EFEMP1 and ELF3; SNAI2, TMEM45A, GABRP, EFEMP1 and PTPN13; SNAI2, TMEM45A, GABRP, EFEMP1 and PTPRM; SNAI2, TMEM45A, GABRP, EFEMP1 and SNCG; SNAI2, TMEM45A, GABRP, EFEMP1 and VGLL1; SNAI2, TMEM45A, GABRP, EFEMP1, PTPRM and CPSF6; SNAI2, TMEM45A, GABRP, EFEMP1, PTPRM and ELF3; SNAI2, TMEM45A, GABRP, EFEMP1, PTPRM and PTPN13; SNAI2, TMEM45A, GABRP, EFEMP1, PTPRM and SNCG; SNAI2, TMEM45A, GABRP, EFEMP1, PTPRM and VGLL1; SNAI2, TMEM45A, GABRP, EFEMP1, PTPRM, CPSF6 and ELF3; SNAI2, TMEM45A, GABRP, EFEMP1, PTPRM, CPSF6 and PTPN13; SNAI2, TMEM45A, GABRP, EFEMP1, PTPRM, CPSF6 and SNCG; SNAI2, TMEM45A, GABRP, EFEMP1, PTPRM, CPSF6 and VGLL1; SNAI2, TMEM45A, GABRP, EFEMP1, PTPRM, CPSF6, PTPN13 and ELF3; SNAI2, TMEM45A, GABRP, EFEMP1, PTPRM, CPSF6, PTPN13 and SNCG; SNAI2, TMEM45A, GABRP, EFEMP1, PTPRM, CPSF6, PTPN13 and VGLL1; SNAI2, TMEM45A, GABRP, EFEMP1, PTPRM, CPSF6, PTPN13, VGLL1 and ELF3; SNAI2, TMEM45A, GABRP, EFEMP1, PTPRM, CPSF6, PTPN13, VGLL1 and SNCG; SNAI2, TMEM45A, GABRP, EFEMP1, PTPRM, CPSF6, PTPN13, VGLL1, ELF3 and SNCG; SNAI2; SNCG; TGFBI and CPSF6; TGFBI and EFEMP1; TGFBI and ELF3; TGFBI and GABRP; TGFBI and GBP1; TGFBI and PTPN13; TGFBI and PTPRM; TGFBI and SNAI2; TGFBI and SNCG; TGFBI and TIMP2; TGFBI and TMEM45A; TGFBI and VGLL1; TGFBI, TIMP2 and CPSF6; TGFBI, TIMP2 and EFEMP1; TGFBI, TIMP2 and ELF3; TGFBI, TIMP2 and GABRP; TGFBI, TIMP2 and GBP1; TGFBI, TIMP2 and PTPN13; TGFBI, TIMP2 and PTPRM; TGFBI, TIMP2 and SNAI2; TGFBI, TIMP2 and SNCG; TGFBI, TIMP2 and TMEM45A; TGFBI, TIMP2 and VGLL1; TGFBI, TIMP2, GBP1 and CPSF6; TGFBI, TIMP2, GBP1 and EFEMP1; TGFBI, TIMP2, GBP1 and ELF3; TGFBI, TIMP2, GBP1 and GABRP; TGFBI, TIMP2, GBP1 and PTPN13; TGFBI, TIMP2, GBP1 and PTPRM; TGFBI, TIMP2, GBP1 and SNAI2; TGFBI, TIMP2, GBP1 and SNCG; TGFBI, TIMP2, GBP1 and TMEM45A; TGFBI, TIMP2, GBP1 and VGLL1; TGFBI, TIMP2, GBP1, SNAI2 and CPSF6; TGFBI, TIMP2, GBP1, SNAI2 and EFEMP1; TGFBI, TIMP2, GBP1, SNAI2 and ELF3; TGFBI, TIMP2, GBP1, SNAI2 and GABRP; TGFBI, TIMP2, GBP1, SNAI2 and PTPN13; TGFBI, TIMP2, GBP1, SNAI2 and PTPRM; TGFBI, TIMP2, GBP1, SNAI2 and SNCG; TGFBI, TIMP2, GBP1, SNAI2 and TMEM45A; TGFBI, TIMP2, GBP1, SNAI2 and VGLL1; TGFBI, TIMP2, GBP1, SNAI2, TMEM45A and CPSF6; TGFBI, TIMP2, GBP1, SNAI2, TMEM45A and EFEMP1; TGFBI, TIMP2, GBP1, SNAI2, TMEM45A and ELF3; TGFBI, TIMP2, GBP1, SNAI2, TMEM45A and GABRP; TGFBI, TIMP2, GBP1, SNAI2, TMEM45A and PTPN13; TGFBI, TIMP2, GBP1, SNAI2, TMEM45A and PTPRM; TGFBI, TIMP2, GBP1, SNAI2, TMEM45A and SNCG; TGFBI, TIMP2, GBP1, SNAI2, TMEM45A and VGLL1; TGFBI, TIMP2, GBP1, SNAI2, TMEM45A, GABRP and CPSF6; TGFBI, TIMP2, GBP1, SNAI2, TMEM45A, GABRP and EFEMP1; TGFBI, TIMP2, GBP1, SNAI2, TMEM45A, GABRP and ELF3; TGFBI, TIMP2, GBP1, SNAI2, TMEM45A, GABRP and PTPN13; TGFBI, TIMP2, GBP1, SNAI2, TMEM45A, GABRP and PTPRM; TGFBI, TIMP2, GBP1, SNAI2, TMEM45A, GABRP and SNCG; TGFBI, TIMP2, GBP1, SNAI2, TMEM45A, GABRP and VGLL1; TGFBI, TIMP2, GBP1, SNAI2, TMEM45A, GABRP, EFEMP1 and CPSF6; TGFBI, TIMP2, GBP1, SNAI2, TMEM45A, GABRP, EFEMP1 and ELF3; TGFBI, TIMP2, GBP1, SNAI2, TMEM45A, GABRP, EFEMP1 and PTPN13; TGFBI, TIMP2, GBP1, SNAI2, TMEM45A, GABRP, EFEMP1 and PTPRM; TGFBI, TIMP2, GBP1, SNAI2, TMEM45A, GABRP, EFEMP1 and SNCG; TGFBI, TIMP2, GBP1, SNAI2, TMEM45A, GABRP, EFEMP1 and VGLL1; TGFBI, TIMP2, GBP1, SNAI2, TMEM45A, GABRP, EFEMP1, PTPRM and CPSF6; TGFBI, TIMP2, GBP1, SNAI2, TMEM45A, GABRP, EFEMP1, PTPRM and ELF3; TGFBI, TIMP2, GBP1, SNAI2, TMEM45A, GABRP, EFEMP1, PTPRM and PTPN13; TGFBI, TIMP2, GBP1, SNAI2, TMEM45A, GABRP, EFEMP1, PTPRM and SNCG; TGFBI, TIMP2, GBP1, SNAI2, TMEM45A, GABRP, EFEMP1, PTPRM and VGLL1; TGFBI, TIMP2, GBP1, SNAI2, TMEM45A, GABRP, EFEMP1, PTPRM, CPSF6 and PTPN13; TGFBI, TIMP2, GBP1, SNAI2, TMEM45A, GABRP, EFEMP1, PTPRM, CPSF6 and VGLL1; TGFBI, TIMP2, GBP1, SNAI2, TMEM45A, GABRP, EFEMP1, PTPRM, CPSF6 and ELF3; TGFBI, TIMP2, GBP1, SNAI2, TMEM45A, GABRP, EFEMP1, PTPRM, CPSF6 and SNCG; TGFBI, TIMP2, GBP1, SNAI2, TMEM45A, GABRP, EFEMP1, PTPRM, CPSF6, PTPN13 and VGLL1; TGFBI, TIMP2, GBP1, SNAI2, TMEM45A, GABRP, EFEMP1, PTPRM, CPSF6, PTPN13 and ELF3; TGFBI, TIMP2, GBP1, SNAI2, TMEM45A, GABRP, EFEMP1, PTPRM, CPSF6, PTPN13 and SNCG; TGFBI, TIMP2, GBP1, SNAI2, TMEM45A, GABRP, EFEMP1, PTPRM, CPSF6, PTPN13, VGLL1 and ELF3; TGFBI, TIMP2, GBP1, SNAI2, TMEM45A, GABRP, EFEMP1, PTPRM, CPSF6, PTPN13, VGLL1 and SNCG; TGFBI, TIMP2, GBP1, SNAI2, TMEM45A, GABRP, EFEMP1, PTPRM, CPSF6, PTPN13, VGLL1, ELF3 and SNCG; TGFBI; TIMP2 and CPSF6; TIMP2 and EFEMP1; TIMP2 and ELF3; TIMP2 and GABRP; TIMP2 and GBP1; TIMP2 and PTPN13; TIMP2 and PTPRM; TIMP2 and SNAI2; TIMP2 and SNCG; TIMP2 and TMEM45A; TIMP2 and VGLL1; TIMP2, GBP1 and CPSF6; TIMP2, GBP1 and EFEMP1; TIMP2, GBP1 and ELF3; TIMP2, GBP1 and GABRP; TIMP2, GBP1 and PTPN13; TIMP2, GBP1 and PTPRM; TIMP2, GBP1 and SNAI2; TIMP2, GBP1 and SNCG; TIMP2, GBP1 and TMEM45A; TIMP2, GBP1 and VGLL1; TIMP2, GBP1, SNAI2 and CPSF6; TIMP2, GBP1, SNAI2 and EFEMP1; TIMP2, GBP1, SNAI2 and ELF3; TIMP2, GBP1, SNAI2 and GABRP; TIMP2, GBP1, SNAI2 and PTPN13; TIMP2, GBP1, SNAI2 and PTPRM; TIMP2, GBP1, SNAI2 and SNCG; TIMP2, GBP1, SNAI2 and TMEM45A; TIMP2, GBP1, SNAI2 and VGLL1; TIMP2, GBP1, SNAI2, TMEM45A and CPSF6; TIMP2, GBP1, SNAI2, TMEM45A and EFEMP1; TIMP2, GBP1, SNAI2, TMEM45A and ELF3; TIMP2, GBP1, SNAI2, TMEM45A and GABRP; TIMP2, GBP1, SNAI2, TMEM45A and PTPN13; TIMP2, GBP1, SNAI2, TMEM45A and PTPRM; TIMP2, GBP1, SNAI2, TMEM45A and SNCG; TIMP2, GBP1, SNAI2, TMEM45A and VGLL1; TIMP2, GBP1, SNAI2, TMEM45A, GABRP and CPSF6; TIMP2, GBP1, SNAI2, TMEM45A, GABRP and EFEMP1; TIMP2, GBP1, SNAI2, TMEM45A, GABRP and ELF3; TIMP2, GBP1, SNAI2, TMEM45A, GABRP and PTPN13; TIMP2, GBP1, SNAI2, TMEM45A, GABRP and PTPRM; TIMP2, GBP1, SNAI2, TMEM45A, GABRP and SNCG; TIMP2, GBP1, SNAI2, TMEM45A, GABRP and VGLL1; TIMP2, GBP1, SNAI2, TMEM45A, GABRP, EFEMP1 and CPSF6; TIMP2, GBP1, SNAI2, TMEM45A, GABRP, EFEMP1 and ELF3; TIMP2, GBP1, SNAI2, TMEM45A, GABRP, EFEMP1 and PTPN13; TIMP2, GBP1, SNAI2, TMEM45A, GABRP, EFEMP1 and PTPRM; TIMP2, GBP1, SNAI2, TMEM45A, GABRP, EFEMP1 and SNCG; TIMP2, GBP1, SNAI2, TMEM45A, GABRP, EFEMP1 and VGLL1; TIMP2, GBP1, SNAI2, TMEM45A, GABRP, EFEMP1, PTPRM and CPSF6; TIMP2, GBP1, SNAI2, TMEM45A, GABRP, EFEMP1, PTPRM and ELF3; TIMP2, GBP1, SNAI2, TMEM45A, GABRP, EFEMP1, PTPRM and PTPN13; TIMP2, GBP1, SNAI2, TMEM45A, GABRP, EFEMP1, PTPRM and SNCG; TIMP2, GBP1, SNAI2, TMEM45A, GABRP, EFEMP1, PTPRM and VGLL1; TIMP2, GBP1, SNAI2, TMEM45A, GABRP, EFEMP1, PTPRM, CPSF6 and ELF3; TIMP2, GBP1, SNAI2, TMEM45A, GABRP, EFEMP1, PTPRM, CPSF6 and PTPN13; TIMP2, GBP1, SNAI2, TMEM45A, GABRP, EFEMP1, PTPRM, CPSF6 and SNCG; TIMP2, GBP1, SNAI2, TMEM45A, GABRP, EFEMP1, PTPRM, CPSF6 and VGLL1; TIMP2, GBP1, SNAI2, TMEM45A, GABRP, EFEMP1, PTPRM, CPSF6, PTPN13 and VGLL1; TIMP2, GBP1, SNAI2, TMEM45A, GABRP, EFEMP1, PTPRM, CPSF6, PTPN13 and ELF3; TIMP2, GBP1, SNAI2, TMEM45A, GABRP, EFEMP1, PTPRM, CPSF6, PTPN13 and SNCG; TIMP2, GBP1, SNAI2, TMEM45A, GABRP, EFEMP1, PTPRM, CPSF6, PTPN13, VGLL1 and ELF3; TIMP2, GBP1, SNAI2, TMEM45A, GABRP, EFEMP1, PTPRM, CPSF6, PTPN13, VGLL1 and SNCG; TIMP2, GBP1, SNAI2, TMEM45A, GABRP, EFEMP1, PTPRM, CPSF6, PTPN13, VGLL1, ELF3 and SNCG; TIMP2; TMEM45A and CPSF6; TMEM45A and EFEMP1; TMEM45A and ELF3; TMEM45A and GABRP; TMEM45A and PTPN13; TMEM45A and PTPRM; TMEM45A and SNCG; TMEM45A and VGLL1; TMEM45A, GABRP and CPSF6; TMEM45A, GABRP and EFEMP1; TMEM45A, GABRP and ELF3; TMEM45A, GABRP and PTPN13; TMEM45A, GABRP and PTPRM; TMEM45A, GABRP and SNCG; TMEM45A, GABRP and VGLL1; TMEM45A, GABRP, EFEMP1 and CPSF6; TMEM45A, GABRP, EFEMP1 and ELF3; TMEM45A, GABRP, EFEMP1 and PTPN13; TMEM45A, GABRP, EFEMP1 and PTPRM; TMEM45A, GABRP, EFEMP1 and SNCG; TMEM45A, GABRP, EFEMP1 and VGLL1; TMEM45A, GABRP, EFEMP1, PTPRM and CPSF6; TMEM45A, GABRP, EFEMP1, PTPRM and ELF3; TMEM45A, GABRP, EFEMP1, PTPRM and PTPN13; TMEM45A, GABRP, EFEMP1, PTPRM and SNCG; TMEM45A, GABRP, EFEMP1, PTPRM and VGLL1; TMEM45A, GABRP, EFEMP1, PTPRM, CPSF6 and ELF3; TMEM45A, GABRP, EFEMP1, PTPRM, CPSF6 and PTPN13; TMEM45A, GABRP, EFEMP1, PTPRM, CPSF6 and SNCG; TMEM45A, GABRP, EFEMP1, PTPRM, CPSF6 and VGLL1; TMEM45A, GABRP, EFEMP1, PTPRM, CPSF6, PTPN13 and ELF3; TMEM45A, GABRP, EFEMP1, PTPRM, CPSF6, PTPN13 and SNCG; TMEM45A, GABRP, EFEMP1, PTPRM, CPSF6, PTPN13 and VGLL1; TMEM45A, GABRP, EFEMP1, PTPRM, CPSF6, PTPN13, VGLL1 and ELF3; TMEM45A, GABRP, EFEMP1, PTPRM, CPSF6, PTPN13, VGLL1 and SNCG; TMEM45A, GABRP, EFEMP1, PTPRM, CPSF6, PTPN13, VGLL1, ELF3 and SNCG; TMEM45A; VGLL1 and ELF3; VGLL1 and SNCG; VGLL1, ELF3 and SNCG; VGLL1; VIM and CPSF6; VIM and EFEMP1; VIM and ELF3; VIM and GABRP; VIM and GBP1; VIM and PTPN13; VIM and PTPRM; VIM and SNAI2; VIM and SNCG; VIM and TGFBI; VIM and TIMP2; VIM and TMEM45A; VIM and VGLL1; VIM, TGFBI and CPSF6; VIM, TGFBI and EFEMP1; VIM, TGFBI and ELF3; VIM, TGFBI and GABRP; VIM, TGFBI and GBP1; VIM, TGFBI and PTPN13; VIM, TGFBI and PTPRM; VIM, TGFBI and SNAI2; VIM, TGFBI and SNCG; VIM, TGFBI and TIMP2; VIM, TGFBI and TMEM45A; VIM, TGFBI and VGLL1; VIM, TGFBI, TIMP2 and CPSF6; VIM, TGFBI, TIMP2 and EFEMP1; VIM, TGFBI, TIMP2 and ELF3; VIM, TGFBI, TIMP2 and GABRP; VIM, TGFBI, TIMP2 and GBP1; VIM, TGFBI, TIMP2 and PTPN13; VIM, TGFBI, TIMP2 and PTPRM; VIM, TGFBI, TIMP2 and SNAI2; VIM, TGFBI, TIMP2 and SNCG; VIM, TGFBI, TIMP2 and TMEM45A; VIM, TGFBI, TIMP2 and VGLL1; VIM, TGFBI, TIMP2, GBP1 and CPSF6; VIM, TGFBI, TIMP2, GBP1 and EFEMP1; VIM, TGFBI, TIMP2, GBP1 and ELF3; VIM, TGFBI, TIMP2, GBP1 and GABRP; VIM, TGFBI, TIMP2, GBP1 and PTPN13; VIM, TGFBI, TIMP2, GBP1 and PTPRM; VIM, TGFBI, TIMP2, GBP1 and SNAI2; VIM, TGFBI, TIMP2, GBP1 and SNCG; VIM, TGFBI, TIMP2, GBP1 and TMEM45A; VIM, TGFBI, TIMP2, GBP1 and VGLL1; VIM, TGFBI, TIMP2, GBP1, SNAI2 and CPSF6; VIM, TGFBI, TIMP2, GBP1, SNAI2 and EFEMP1; VIM, TGFBI, TIMP2, GBP1, SNAI2 and ELF3; VIM, TGFBI, TIMP2, GBP1, SNAI2 and GABRP; VIM, TGFBI, TIMP2, GBP1, SNAI2 and PTPN13; VIM, TGFBI, TIMP2, GBP1, SNAI2 and PTPRM; VIM, TGFBI, TIMP2, GBP1, SNAI2 and SNCG; VIM, TGFBI, TIMP2, GBP1, SNAI2 and TMEM45A; VIM, TGFBI, TIMP2, GBP1, SNAI2 and VGLL1; VIM, TGFBI, TIMP2, GBP1, SNAI2, TMEM45A and CPSF6; VIM, TGFBI, TIMP2, GBP1, SNAI2, TMEM45A and EFEMP1; VIM, TGFBI, TIMP2, GBP1, SNAI2, TMEM45A and ELF3; VIM, TGFBI, TIMP2, GBP1, SNAI2, TMEM45A and GABRP; VIM, TGFBI, TIMP2, GBP1, SNAI2, TMEM45A and PTPN13; VIM, TGFBI, TIMP2, GBP1, SNAI2, TMEM45A and PTPRM; VIM, TGFBI, TIMP2, GBP1, SNAI2, TMEM45A and SNCG; VIM, TGFBI, TIMP2, GBP1, SNAI2, TMEM45A and VGLL1; VIM, TGFBI, TIMP2, GBP1, SNAI2, TMEM45A, GABRP and CPSF6; VIM, TGFBI, TIMP2, GBP1, SNAI2, TMEM45A, GABRP and EFEMP1; VIM, TGFBI, TIMP2, GBP1, SNAI2, TMEM45A, GABRP and ELF3; VIM, TGFBI, TIMP2, GBP1, SNAI2, TMEM45A, GABRP and PTPN13; VIM, TGFBI, TIMP2, GBP1, SNAI2, TMEM45A, GABRP and PTPRM; VIM, TGFBI, TIMP2, GBP1, SNAI2, TMEM45A, GABRP and SNCG; VIM, TGFBI, TIMP2, GBP1, SNAI2, TMEM45A, GABRP and VGLL1; VIM, TGFBI, TIMP2, GBP1, SNAI2, TMEM45A, GABRP, EFEMP1 and CPSF6; VIM, TGFBI, TIMP2, GBP1, SNAI2, TMEM45A, GABRP, EFEMP1 and ELF3; VIM, TGFBI, TIMP2, GBP1, SNAI2, TMEM45A, GABRP, EFEMP1 and PTPN13; VIM, TGFBI, TIMP2, GBP1, SNAI2, TMEM45A, GABRP, EFEMP1 and PTPRM; VIM, TGFBI, TIMP2, GBP1, SNAI2, TMEM45A, GABRP, EFEMP1 and SNCG; VIM, TGFBI, TIMP2, GBP1, SNAI2, TMEM45A, GABRP, EFEMP1 and VGLL1; VIM, TGFBI, TIMP2, GBP1, SNAI2, TMEM45A, GABRP, EFEMP1, PTPRM and CPSF6; VIM, TGFBI, TIMP2, GBP1, SNAI2, TMEM45A, GABRP, EFEMP1, PTPRM and PTPN13; VIM, TGFBI, TIMP2, GBP1, SNAI2, TMEM45A, GABRP, EFEMP1, PTPRM and VGLL1; VIM, TGFBI, TIMP2, GBP1, SNAI2, TMEM45A, GABRP, EFEMP1, PTPRM and ELF3; VIM, TGFBI, TIMP2, GBP1, SNAI2, TMEM45A, GABRP, EFEMP1, PTPRM and SNCG; VIM, TGFBI, TIMP2, GBP1, SNAI2, TMEM45A, GABRP, EFEMP1, PTPRM, CPSF6 and PTPN13; VIM, TGFBI, TIMP2, GBP1, SNAI2, TMEM45A, GABRP, EFEMP1, PTPRM, CPSF6 and VGLL1; VIM, TGFBI, TIMP2, GBP1, SNAI2, TMEM45A, GABRP, EFEMP1, PTPRM, CPSF6 and ELF3; VIM, TGFBI, TIMP2, GBP1, SNAI2, TMEM45A, GABRP, EFEMP1, PTPRM, CPSF6 and SNCG; VIM, TGFBI, TIMP2, GBP1, SNAI2, TMEM45A, GABRP, EFEMP1, PTPRM, CPSF6, PTPN13 and VGLL1; VIM, TGFBI, TIMP2, GBP1, SNAI2, TMEM45A, GABRP, EFEMP1, PTPRM, CPSF6, PTPN13 and ELF3; VIM, TGFBI, TIMP2, GBP1, SNAI2, TMEM45A, GABRP, EFEMP1, PTPRM, CPSF6, PTPN13 and SNCG; VIM, TGFBI, TIMP2, GBP1, SNAI2, TMEM45A, GABRP, EFEMP1, PTPRM, CPSF6, PTPN13, VGLL1 and ELF3; VIM, TGFBI, TIMP2, GBP1, SNAI2, TMEM45A, GABRP, EFEMP1, PTPRM, CPSF6, PTPN13, VGLL1 and SNCG; VIM, TGFBI, TIMP2, GBP1, SNAI2, TMEM45A, GABRP, EFEMP1, PTPRM, CPSF6, PTPN13, VGLL1, ELF3 and SNCG; and VIM.

In some instances, the plurality of targets comprises a coding target, non-coding target, or any combination thereof. In some instances, the coding target comprises an exonic sequence. In other instances, the non-coding target comprises a non-exonic or exonic sequence. Alternatively, a non-coding target comprises a UTR sequence, an intronic sequence, antisense, or a non-coding RNA transcript. In some instances, a non-coding target comprises sequences which partially overlap with a UTR sequence or an intronic sequence. A non-coding target also includes non-exonic and/or exonic transcripts. Exonic sequences may comprise regions on a protein-coding gene, such as an exon, UTR, or a portion thereof. Non-exonic sequences may comprise regions on a protein-coding, non-protein-coding gene, or a portion thereof. For example, non-exonic sequences may comprise intronic regions, promoter regions, intergenic regions, a non-coding transcript, an exon anti-sense region, an intronic anti-sense region, UTR anti-sense region, non-coding transcript anti-sense region, or a portion thereof. In other instances, the plurality of targets comprises a non-coding RNA transcript.

The plurality of targets may comprise one or more targets selected from a classifier disclosed herein. The classifier may be generated from one or more models or algorithms. The one or more models or algorithms may be Naïve Bayes (NB), recursive Partitioning (Rpart), random forest (RF), support vector machine (SVM), k-nearest neighbor (KNN), high dimensional discriminate analysis (HDDA), or a combination thereof. The classifier may have an AUC of equal to or greater than 0.60. The classifier may have an AUC of equal to or greater than 0.61. The classifier may have an AUC of equal to or greater than 0.62. The classifier may have an AUC of equal to or greater than 0.63. The classifier may have an AUC of equal to or greater than 0.64. The classifier may have an AUC of equal to or greater than 0.65. The classifier may have an AUC of equal to or greater than 0.66. The classifier may have an AUC of equal to or greater than 0.67. The classifier may have an AUC of equal to or greater than 0.68. The classifier may have an AUC of equal to or greater than 0.69. The classifier may have an AUC of equal to or greater than 0.70. The classifier may have an AUC of equal to or greater than 0.75. The classifier may have an AUC of equal to or greater than 0.77. The classifier may have an AUC of equal to or greater than 0.78. The classifier may have an AUC of equal to or greater than 0.79. The classifier may have an AUC of equal to or greater than 0.80. The AUC may be clinically significant based on its 95% confidence interval (CI). The accuracy of the classifier may be at least about 70%. The accuracy of the classifier may be at least about 73%. The accuracy of the classifier may be at least about 75%. The accuracy of the classifier may be at least about 77%. The accuracy of the classifier may be at least about 80%. The accuracy of the classifier may be at least about 83%. The accuracy of the classifier may be at least about 84%. The accuracy of the classifier may be at least about 86%. The accuracy of the classifier may be at least about 88%. The accuracy of the classifier may be at least about 90%. The p-value of the classifier may be less than or equal to 0.05. The p-value of the classifier may be less than or equal to 0.04. The p-value of the classifier may be less than or equal to 0.03. The p-value of the classifier may be less than or equal to 0.02. The p-value of the classifier may be less than or equal to 0.01. The p-value of the classifier may be less than or equal to 0.008. The p-value of the classifier may be less than or equal to 0.006. The p-value of the classifier may be less than or equal to 0.004. The p-value of the classifier may be less than or equal to 0.002. The p-value of the classifier may be less than or equal to 0.001.

The plurality of targets may comprise one or more targets selected from a Random Forest (RF) classifier. The plurality of targets may comprise two or more targets selected from a Random Forest (RF) classifier. The plurality of targets may comprise three or more targets selected from a Random Forest (RF) classifier. The plurality of targets may comprise 2, 3, 4, 5, 6, 7, 8, 9, 10, 11, 12, 13, 14, 15, 20, 25, 30, 35, 40, 45, 50, or more targets selected from a Random Forest (RF) classifier. The RF classifier may be an RF2, and RF3, or an RF4 classifier. The RF classifier may be an RF22 classifier (e.g., a Random Forest classifier with 22 targets). For example, a RF classifier of the present invention may comprise two or more targets selected from Table 3, Table 5, Table 13 or SEQ ID Nos: 1-4050.

The plurality of targets may comprise one or more targets selected from an SVM classifier. The plurality of targets may comprise 2, 3, 4, 5, 6, 7, 8, 9, 10 or more targets selected from an SVM classifier. The plurality of targets may comprise 12, 13, 14, 15, 17, 20, 22, 25, 27, 30 or more targets selected from an SVM classifier. The plurality of targets may comprise 32, 35, 37, 40, 43, 45, 47, 50, 53, 55, 57, 60 or more targets selected from an SVM classifier. The SVM classifier may be an SVM2 classifier. A SVM classifier of the present invention may comprise two or more targets selected from Table 3, Table 5, Table 13 or SEQ ID Nos: 1-4050.

The plurality of targets may comprise one or more targets selected from a KNN classifier. The plurality of targets may comprise 2, 3, 4, 5, 6, 7, 8, 9, 10 or more targets selected from a KNN classifier. The plurality of targets may comprise 12, 13, 14, 15, 17, 20, 22, 25, 27, 30 or more targets selected from a KNN classifier. The plurality of targets may comprise 32, 35, 37, 40, 43, 45, 47, 50, 53, 55, 57, 60 or more targets selected from a KNN classifier. The plurality of targets may comprise 65, 70, 75, 80, 85, 90, 95, 100 or more targets selected from a KNN classifier. For example, a KNN classifier of the present invention may comprise two or more targets selected from Table 3, Table 5, Table 13 or SEQ ID Nos: 1-4050.

The plurality of targets may comprise one or more targets selected from a Naïve Bayes (NB) classifier. The plurality of targets may comprise 2, 3, 4, 5, 6, 7, 8, 9, 10 or more targets selected from an NB classifier. The plurality of targets may comprise 12, 13, 14, 15, 17, 20, 22, 25, 27, 30 or more targets selected from an NB classifier. The plurality of targets may comprise 32, 35, 37, 40, 43, 45, 47, 50, 53, 55, 57, 60 or more targets selected from a NB classifier. The plurality of targets may comprise 65, 70, 75, 80, 85, 90, 95, 100 or more targets selected from a NB classifier. For example, a NB classifier of the present invention may comprise two or more targets selected from Table 3, Table 5, Table 13 or SEQ ID Nos: 1-4050.

The plurality of targets may comprise one or more targets selected from a recursive partitioning (Rpart) classifier. The plurality of targets may comprise 2, 3, 4, 5, 6, 7, 8, 9, 10 or more targets selected from an Rpart classifier. The plurality of targets may comprise 12, 13, 14, 15, 17, 20, 22, 25, 27, 30 or more targets selected from an Rpart classifier. The plurality of targets may comprise 32, 35, 37, 40, 43, 45, 47, 50, 53, 55, 57, 60 or more targets selected from an Rpart classifier. The plurality of targets may comprise 65, 70, 75, 80, 85, 90, 95, 100 or more targets selected from an Rpart classifier. For example, an Rpart classifier of the present invention may comprise two or more targets selected from Table 3, Table 5, Table 13 or SEQ ID Nos: 1-4050.

The plurality of targets may comprise one or more targets selected from a high dimensional discriminate analysis (HDDA) classifier. The plurality of targets may comprise two or more targets selected from a high dimensional discriminate analysis (HDDA) classifier. The plurality of targets may comprise three or more targets selected from a high dimensional discriminate analysis (HDDA) classifier. The plurality of targets may comprise 5, 6, 7, 8, 9, 10, 11, 12, 13, 14, 15 or more targets selected from a high dimensional discriminate analysis (HDDA) classifier. For example, an Rpart classifier of the present invention may comprise two or more targets selected from Table 3, Table 5, Table 13 or SEQ ID Nos: 1-4050.

Probes/Primers

The present invention provides a probe set for predicting benefit from neoadjuvant chemotherapy and/or diagnosing, monitoring and/or predicting a status or outcome of bladder cancer in a subject, the probe set comprising a plurality of probes, wherein (i) the probes in the set are capable of detecting an expression level of at least one target selected from Table 3, Table 5, Table 13 or SEQ ID Nos: 1-4050; and (ii) the expression level determines the cancer status of the subject with at least about 40% specificity.

The probe set may comprise one or more polynucleotide probes. Individual polynucleotide probes comprise a nucleotide sequence derived from the nucleotide sequence of the target sequences or complementary sequences thereof. The nucleotide sequence of the polynucleotide probe is designed such that it corresponds to, or is complementary to the target sequences. The polynucleotide probe can specifically hybridize under either stringent or lowered stringency hybridization conditions to a region of the target sequences, to the complement thereof, or to a nucleic acid sequence (such as a cDNA) derived therefrom.

The selection of the polynucleotide probe sequences and determination of their uniqueness may be carried out in silico using techniques known in the art, for example, based on a BLASTN search of the polynucleotide sequence in question against gene sequence databases, such as the Human Genome Sequence, UniGene, dbEST or the non-redundant database at NCBI. In one embodiment of the invention, the polynucleotide probe is complementary to a region of a target mRNA derived from a target sequence in the probe set. Computer programs can also be employed to select probe sequences that may not cross hybridize or may not hybridize non-specifically.

In some instances, microarray hybridization of RNA, extracted from bladder cancer tissue samples and amplified, may yield a dataset that is then summarized and normalized by the fRMA technique. After removal (or filtration) of cross-hybridizing PSRs, and PSRs containing less than 4 probes, the remaining PSRs can be used in further analysis. Following fRMA and filtration, the data can be decomposed into its principal components and an analysis of variance model is used to determine the extent to which a batch effect remains present in the first 10 principal components.

These remaining PSRs can then be subjected to filtration by a T-test between CR (clinical recurrence) and non-CR samples. Using a p-value cut-off of 0.01, the remaining features (e.g., PSRs) can be further refined. Feature selection can be performed by regularized logistic regression using the elastic-net penalty. The regularized regression may be bootstrapped over 1000 times using all training data; with each iteration of bootstrapping, features that have non-zero co-efficient following 3-fold cross validation can be tabulated. In some instances, features that were selected in at least 25% of the total runs were used for model building.

The polynucleotide probes of the present invention may range in length from about 15 nucleotides to the full length of the coding target or non-coding target. In one embodiment of the invention, the polynucleotide probes are at least about 15 nucleotides in length. In another embodiment, the polynucleotide probes are at least about 20 nucleotides in length. In a further embodiment, the polynucleotide probes are at least about 25 nucleotides in length. In another embodiment, the polynucleotide probes are between about 15 nucleotides and about 500 nucleotides in length. In other embodiments, the polynucleotide probes are between about 15 nucleotides and about 450 nucleotides, about 15 nucleotides and about 400 nucleotides, about 15 nucleotides and about 350 nucleotides, about 15 nucleotides and about 300 nucleotides, about 15 nucleotides and about 250 nucleotides, about 15 nucleotides and about 200 nucleotides in length. In some embodiments, the probes are at least 15 nucleotides in length. In some embodiments, the probes are at least 15 nucleotides in length. In some embodiments, the probes are at least 20 nucleotides, at least 25 nucleotides, at least 50 nucleotides, at least 75 nucleotides, at least 100 nucleotides, at least 125 nucleotides, at least 150 nucleotides, at least 200 nucleotides, at least 225 nucleotides, at least 250 nucleotides, at least 275 nucleotides, at least 300 nucleotides, at least 325 nucleotides, at least 350 nucleotides, at least 375 nucleotides in length.

The polynucleotide probes of a probe set can comprise RNA, DNA, RNA or DNA mimetics, or combinations thereof, and can be single-stranded or double-stranded. Thus the polynucleotide probes can be composed of naturally-occurring nucleobases, sugars and covalent internucleoside (backbone) linkages as well as polynucleotide probes having non-naturally-occurring portions which function similarly. Such modified or substituted polynucleotide probes may provide desirable properties such as, for example, enhanced affinity for a target gene and increased stability. The probe set may comprise a coding target and/or a non-coding target. Preferably, the probe set comprises a combination of a coding target and non-coding target.

In some embodiments, the probe set comprise a plurality of target sequences that hybridize to at least about 5 coding targets and/or non-coding targets selected from Table 3, Table 5, Table 13 or SEQ ID Nos: 1-4050. Alternatively, the probe set comprise a plurality of target sequences that hybridize to at least about 10 coding targets and/or non-coding targets selected from Table 3, Table 5, Table 13 or SEQ ID Nos: 1-4050. In some embodiments, the probe set comprise a plurality of target sequences that hybridize to at least about 15 coding targets and/or non-coding targets selected from Table 3, Table 5, Table 13 or SEQ ID Nos: 1-4050. In some embodiments, the probe set comprise a plurality of target sequences that hybridize to at least about 20 coding targets and/or non-coding targets selected from Table 3, Table 5, Table 13 or SEQ ID Nos: 1-4050. In some embodiments, the probe set comprise a plurality of target sequences that hybridize to at least about 30 coding targets and/or non-coding targets selected from Table 3, Table 5, Table 13 or SEQ ID Nos: 1-4050.

The system of the present invention further provides for primers and primer pairs capable of amplifying target sequences defined by the probe set, or fragments or subsequences or complements thereof. The nucleotide sequences of the probe set may be provided in computer-readable media for in silico applications and as a basis for the design of appropriate primers for amplification of one or more target sequences of the probe set.

Primers based on the nucleotide sequences of target sequences can be designed for use in amplification of the target sequences. For use in amplification reactions such as PCR, a pair of primers can be used. The exact composition of the primer sequences is not critical to the invention, but for most applications the primers may hybridize to specific sequences of the probe set under stringent conditions, particularly under conditions of high stringency, as known in the art. The pairs of primers are usually chosen so as to generate an amplification product of at least about 50 nucleotides, more usually at least about 100 nucleotides. Algorithms for the selection of primer sequences are generally known, and are available in commercial software packages. These primers may be used in standard quantitative or qualitative PCR-based assays to assess transcript expression levels of RNAs defined by the probe set. Alternatively, these primers may be used in combination with probes, such as molecular beacons in amplifications using real-time PCR.

In one embodiment, the primers or primer pairs, when used in an amplification reaction, specifically amplify at least a portion of a nucleic acid sequence of a target selected from Table 3, Table 5, Table 13 or SEQ ID Nos: 1-4050 (or subgroups thereof as set forth herein), an RNA form thereof, or a complement to either thereof.

A label can optionally be attached to or incorporated into a probe or primer polynucleotide to allow detection and/or quantitation of a target polynucleotide representing the target sequence of interest. The target polynucleotide may be the expressed target sequence RNA itself, a cDNA copy thereof, or an amplification product derived therefrom, and may be the positive or negative strand, so long as it can be specifically detected in the assay being used. Similarly, an antibody may be labeled.

In certain multiplex formats, labels used for detecting different targets may be distinguishable. The label can be attached directly (e.g., via covalent linkage) or indirectly, e.g., via a bridging molecule or series of molecules (e.g., a molecule or complex that can bind to an assay component, or via members of a binding pair that can be incorporated into assay components, e.g. biotin-avidin or streptavidin). Many labels are commercially available in activated forms which can readily be used for such conjugation (for example through amine acylation), or labels may be attached through known or determinable conjugation schemes, many of which are known in the art.

Labels useful in the invention described herein include any substance which can be detected when bound to or incorporated into the biomolecule of interest. Any effective detection method can be used, including optical, spectroscopic, electrical, piezoelectrical, magnetic, Raman scattering, surface plasmon resonance, colorimetric, calorimetric, etc. A label is typically selected from a chromophore, a lumiphore, a fluorophore, one member of a quenching system, a chromogen, a hapten, an antigen, a magnetic particle, a material exhibiting nonlinear optics, a semiconductor nanocrystal, a metal nanoparticle, an enzyme, an antibody or binding portion or equivalent thereof, an aptamer, and one member of a binding pair, and combinations thereof. Quenching schemes may be used, wherein a quencher and a fluorophore as members of a quenching pair may be used on a probe, such that a change in optical parameters occurs upon binding to the target introduce or quench the signal from the fluorophore. One example of such a system is a molecular beacon. Suitable quencher/fluorophore systems are known in the art. The label may be bound through a variety of intermediate linkages. For example, a polynucleotide may comprise a biotin-binding species, and an optically detectable label may be conjugated to biotin and then bound to the labeled polynucleotide. Similarly, a polynucleotide sensor may comprise an immunological species such as an antibody or fragment, and a secondary antibody containing an optically detectable label may be added.

Chromophores useful in the methods described herein include any substance which can absorb energy and emit light. For multiplexed assays, a plurality of different signaling chromophores can be used with detectably different emission spectra. The chromophore can be a lumophore or a fluorophore. Typical fluorophores include fluorescent dyes, semiconductor nanocrystals, lanthanide chelates, polynucleotide-specific dyes and green fluorescent protein.

In some embodiments, polynucleotides of the invention comprise at least 20 consecutive bases of the nucleic acid sequence of a target selected from Table 3, Table 5, Table 13 or SEQ ID Nos: 1-4050 or a complement thereto. The polynucleotides may comprise at least 21, 22, 23, 24, 25, 27, 30, 32, 35, 40, 45, 50, or more consecutive bases of the nucleic acids sequence of a target selected from Table 3, Table 5, Table 13 or SEQ ID Nos: 1-4050, as applicable.

The polynucleotides may be provided in a variety of formats, including as solids, in solution, or in an array. The polynucleotides may optionally comprise one or more labels, which may be chemically and/or enzymatically incorporated into the polynucleotide.

In some embodiments, one or more polynucleotides provided herein can be provided on a substrate. The substrate can comprise a wide range of material, either biological, nonbiological, organic, inorganic, or a combination of any of these. For example, the substrate may be a polymerized Langmuir Blodgett film, functionalized glass, Si, Ge, GaAs, GaP, $SiO_2$, $SiN_4$, modified silicon, or any one of a wide variety of gels or polymers such as (poly)tetrafluoroethylene, (poly)vinylidenedifluoride, polystyrene, cross-linked polystyrene, polyacrylic, polylactic acid, polyglycolic acid, poly(lactide coglycolide), polyanhydrides, poly(methyl methacrylate), poly(ethylene-co-vinyl acetate), polysiloxanes, polymeric silica, latexes, dextran polymers, epoxies, polycarbonates, or combinations thereof. Conducting polymers and photoconductive materials can be used.

The substrate can take the form of an array, a photodiode, an optoelectronic sensor such as an optoelectronic semiconductor chip or optoelectronic thin-film semiconductor, or a biochip. The location(s) of probe(s) on the substrate can be addressable; this can be done in highly dense formats, and the location(s) can be microaddressable or nanoaddressable.

Diagnostic Samples

A biological sample is collected from a subject in need of treatment for cancer to evaluate whether a patient will benefit from neoadjuvant chemotherapy. Diagnostic samples for use with the systems and in the methods of the present invention comprise nucleic acids suitable for providing RNAs expression information. In principle, the biological sample from which the expressed RNA is obtained and analyzed for target sequence expression can be any material suspected of comprising cancerous bladder tissue or cells. The diagnostic sample can be a biological sample used directly in a method of the invention. Alternatively, the diagnostic sample can be a sample prepared from a biological sample.

In one embodiment, the sample or portion of the sample comprising or suspected of comprising cancerous tissue or cells can be any source of biological material, including cells, tissue or fluid, including bodily fluids. Non-limiting examples of the source of the sample include an aspirate, a needle biopsy, a cytology pellet, a bulk tissue preparation or a section thereof obtained for example by surgery or autopsy, lymph fluid, blood, plasma, serum, tumors, and organs. In some embodiments, the sample is from urine comprising cancerous cells. Alternatively, the sample is from a bladder tumor biopsy.

The samples may be archival samples, having a known and documented medical outcome, or may be samples from current patients whose ultimate medical outcome is not yet known.

In some embodiments, the sample may be dissected prior to molecular analysis. The sample may be prepared via macrodissection of a bulk tumor specimen or portion thereof, or may be treated via microdissection, for example via Laser Capture Microdissection (LCM).

The sample may initially be provided in a variety of states, as fresh tissue, fresh frozen tissue, fine needle aspirates, and may be fixed or unfixed. Frequently, medical laboratories routinely prepare medical samples in a fixed state, which facilitates tissue storage. A variety of fixatives can be used to fix tissue to stabilize the morphology of cells, and may be used alone or in combination with other agents. Exemplary fixatives include crosslinking agents, alcohols, acetone, Bouin's solution, Zenker solution, Hely solution, osmic acid solution and Carnoy solution.

Crosslinking fixatives can comprise any agent suitable for forming two or more covalent bonds, for example an aldehyde. Sources of aldehydes typically used for fixation include formaldehyde, paraformaldehyde, glutaraldehyde or formalin. Preferably, the crosslinking agent comprises formaldehyde, which may be included in its native form or in the form of paraformaldehyde or formalin. One of skill in the art would appreciate that for samples in which crosslinking fixatives have been used special preparatory steps may be necessary including for example heating steps and proteinase-k digestion; see methods.

One or more alcohols may be used to fix tissue, alone or in combination with other fixatives. Exemplary alcohols used for fixation include methanol, ethanol and isopropanol.

Formalin fixation is frequently used in medical laboratories. Formalin comprises both an alcohol, typically methanol, and formaldehyde, both of which can act to fix a biological sample.

Whether fixed or unfixed, the biological sample may optionally be embedded in an embedding medium. Exemplary embedding media used in histology including paraffin, Tissue-Tek® V.I.P.™, Paramat, Paramat Extra, Paraplast, Paraplast X-tra, Paraplast Plus, Peel Away Paraffin Embedding Wax, Polyester Wax, Carbowax Polyethylene Glycol, Polyfin™, Tissue Freezing Medium TFMFM, Cryo-Gef™, and OCT Compound (Electron Microscopy Sciences, Hatfield, Pa.). Prior to molecular analysis, the embedding material may be removed via any suitable techniques, as known in the art. For example, where the sample is embedded in wax, the embedding material may be removed by extraction with organic solvent(s), for example xylenes. Kits are commercially available for removing embedding media from tissues. Samples or sections thereof may be subjected to further processing steps as needed, for example serial hydration or dehydration steps.

In some embodiments, the sample is a fixed, wax-embedded biological sample. Frequently, samples from medical laboratories are provided as fixed, wax-embedded samples, most commonly as formalin-fixed, paraffin embedded (FFPE) tissues.

Whatever the source of the biological sample, the target polynucleotide that is ultimately assayed can be prepared synthetically (in the case of control sequences), but typically is purified from the biological source and subjected to one or more preparative steps. The RNA may be purified to remove or diminish one or more undesired components from the biological sample or to concentrate it. Conversely, where the RNA is too concentrated for the particular assay, it may be diluted.

RNA Extraction

RNA can be extracted and purified from biological samples using any suitable technique. A number of techniques are known in the art, and several are commercially available (e.g., FormaPure nucleic acid extraction kit, Agencourt Biosciences, Beverly Mass., High Pure FFPE RNA Micro Kit, Roche Applied Science, Indianapolis, Ind.). RNA can be extracted from frozen tissue sections using TRIzol (Invitrogen, Carlsbad, Calif.) and purified using RNeasy Protect kit (Qiagen, Valencia, Calif.). RNA can be further purified using DNAse I treatment (Ambion, Austin, Tex.) to eliminate any contaminating DNA. RNA concentrations can be made using a Nanodrop ND-1000 spectrophotometer (Nanodrop Technologies, Rockland, Del.). RNA can be further purified to eliminate contaminants that interfere with cDNA synthesis by cold sodium acetate precipitation. RNA integrity can be evaluated by running electropherograms, and RNA integrity number (RIN, a correlative measure that indicates intactness of mRNA) can be determined using the RNA 6000 PicoAssay for the Bioanalyzer 2100 (Agilent Technologies, Santa Clara, Calif.).

Kits

Kits for performing the desired method(s) are also provided, and comprise a container or housing for holding the components of the kit, one or more vessels containing one or more nucleic acid(s), and optionally one or more vessels containing one or more reagents. The reagents include those described in the composition of matter section above, and those reagents useful for performing the methods described, including amplification reagents, and may include one or more probes, primers or primer pairs, enzymes (including polymerases and ligases), intercalating dyes, labeled probes, and labels that can be incorporated into amplification products.

In some embodiments, the kit comprises primers or primer pairs specific for those subsets and combinations of target sequences described herein. The primers or pairs of primers are suitable for selectively amplifying the target sequences. The kit may comprise at least two, three, four or five primers or pairs of primers suitable for selectively amplifying one or more targets. The kit may comprise at least 5, 10, 15, 20, 30, 40, 50, 60, 70, 80, 90, 100, 110, or more primers or pairs of primers suitable for selectively amplifying one or more targets.

In some embodiments, the primers or primer pairs of the kit, when used in an amplification reaction, specifically amplify a non-coding target, coding target, exonic, or non-exonic target described herein, a nucleic acid sequence corresponding to a target selected from Table 3, Table 5, Table 13 or SEQ ID Nos: 1-4050, an RNA form thereof, or a complement to either thereof. The kit may include a plurality of such primers or primer pairs which can specifically amplify a corresponding plurality of different amplify a non-coding target, coding target, exonic, or non-exonic transcript described herein, a nucleic acid sequence corresponding to a target selected from Table 3, Table 5, Table 13 or SEQ ID Nos: 1-4050, RNA forms thereof, or complements thereto. At least two, three, four or five primers or pairs of primers suitable for selectively amplifying the one or more targets can be provided in kit form. In some embodiments, the kit comprises from five to fifty primers or pairs of primers suitable for amplifying the one or more targets.

The reagents may independently be in liquid or solid form. The reagents may be provided in mixtures. Control samples and/or nucleic acids may optionally be provided in the kit. Control samples may include tissue and/or nucleic acids obtained from or representative of tumor samples from patients showing no evidence of disease, as well as tissue and/or nucleic acids obtained from or representative of tumor samples from patients that develop systemic cancer.

The nucleic acids may be provided in an array format, and thus an array or microarray may be included in the kit. The kit optionally may be certified by a government agency for use in prognosing the disease outcome of cancer patients and/or for designating a treatment modality.

Instructions for using the kit to perform one or more methods of the invention can be provided with the container, and can be provided in any fixed medium. The instructions may be located inside or outside the container or housing, and/or may be printed on the interior or exterior of any surface thereof. A kit may be in multiplex form for concurrently detecting and/or quantitating one or more different target polynucleotides representing the expressed target sequences.

Amplification and Hybridization

Following sample collection and nucleic acid extraction, the nucleic acid portion of the sample comprising RNA that is or can be used to prepare the target polynucleotide(s) of interest can be subjected to one or more preparative reactions. These preparative reactions can include in vitro transcription (IVT), labeling, fragmentation, amplification and other reactions. The mRNA can first be treated with reverse transcriptase and a primer to create cDNA prior to detection, quantitation and/or amplification; this can be done in vitro with purified mRNA or in situ, e.g., in cells or tissues affixed to a slide.

By "amplification" is meant any process of producing at least one copy of a nucleic acid, in this case an expressed RNA, and in many cases produces multiple copies. An amplification product can be RNA or DNA, and may include a complementary strand to the expressed target sequence. DNA amplification products can be produced initially through reverse translation and then optionally from further amplification reactions. The amplification product may include all or a portion of a target sequence, and may optionally be labeled. A variety of amplification methods are suitable for use, including polymerase-based methods and ligation-based methods. Exemplary amplification techniques include the polymerase chain reaction method (PCR), the lipase chain reaction (LCR), ribozyme-based methods, self-sustained sequence replication (3SR), nucleic acid sequence-based amplification (NASBA), and the use of Q Beta replicase, reverse transcription, nick translation, and the like.

Asymmetric amplification reactions may be used to preferentially amplify one strand representing the target sequence that is used for detection as the target polynucleotide. In some cases, the presence and/or amount of the amplification product itself may be used to determine the expression level of a given target sequence. In other instances, the amplification product may be used to hybridize to an array or other substrate comprising sensor polynucleotides which are used to detect and/or quantitate target sequence expression.

The first cycle of amplification in polymerase-based methods typically forms a primer extension product complementary to the template strand. If the template is single-stranded RNA, a polymerase with reverse transcriptase activity is used in the first amplification to reverse transcribe the RNA to DNA, and additional amplification cycles can be performed to copy the primer extension products. The primers for a PCR must, of course, be designed to hybridize to regions in their corresponding template that can produce an amplifiable segment; thus, each primer must hybridize so that its 3' nucleotide is paired to a nucleotide in its complementary template strand that is located 3' from the 3' nucleotide of the primer used to replicate that complementary template strand in the PCR.

The target polynucleotide can be amplified by contacting one or more strands of the target polynucleotide with a primer and a polymerase having suitable activity to extend the primer and copy the target polynucleotide to produce a full-length complementary polynucleotide or a smaller portion thereof. Any enzyme having a polymerase activity that can copy the target polynucleotide can be used, including DNA polymerases, RNA polymerases, reverse transcriptases, and enzymes having more than one type of polymerase or enzyme activity. The enzyme can be thermolabile or thermostable. Mixtures of enzymes can also be used. Exemplary enzymes include: DNA polymerases such as DNA Polymerase I ("Pol I"), the Klenow fragment of Pol I, T4, T7, Sequenase® T7, Sequenase® Version 2.0 T7, Tub, Taq, Tth, Pfic, Pfu, Tsp, Tfl, Tli and *Pyrococcus* sp GB-D DNA polymerases; RNA polymerases such as *E. coil*, SP6, T3 and T7 RNA polymerases; and reverse transcriptases such as AMV, M-MuLV, MMLV, RNAse H MMLV (SuperScript®), SuperScript® II, ThermoScript®, HIV-1, and RAV2 reverse transcriptases. All of these enzymes are commercially available. Exemplary polymerases with multiple specificities include RAV2 and Tli (exo-) polymerases. Exemplary thermostable polymerases include Tub, Taq, Tth, Pfic, Pfu, Tsp, Tfl, Tli and *Pyrococcus* sp. GB-D DNA polymerases.

Suitable reaction conditions are chosen to permit amplification of the target polynucleotide, including pH, buffer, ionic strength, presence and concentration of one or more salts, presence and concentration of reactants and cofactors such as nucleotides and magnesium and/or other metal ions (e.g., manganese), optional cosolvents, temperature, thermal cycling profile for amplification schemes comprising a polymerase chain reaction, and may depend in part on the polymerase being used as well as the nature of the sample. Cosolvents include formamide (typically at from about 2 to about 10%), glycerol (typically at from about 5 to about 10%), and DMSO (typically at from about 0.9 to about 10%). Techniques may be used in the amplification scheme in order to minimize the production of false positives or artifacts produced during amplification. These include "touchdown" PCR, hot-start techniques, use of nested primers, or designing PCR primers so that they form stem-loop structures in the event of primer-dimer formation and thus are not amplified. Techniques to accelerate PCR can be used, for example centrifugal PCR, which allows for greater convection within the sample, and comprising infrared heating steps for rapid heating and cooling of the sample. One or more cycles of amplification can be performed. An excess of one primer can be used to produce an excess of one primer extension product during PCR; preferably, the primer extension product produced in excess is the amplification product to be detected. A plurality of different primers may be used to amplify different target polynucleotides or different regions of a particular target polynucleotide within the sample.

An amplification reaction can be performed under conditions which allow an optionally labeled sensor polynucleotide to hybridize to the amplification product during at least part of an amplification cycle. When the assay is performed in this manner, real-time detection of this hybridization event can take place by monitoring for light emission or fluorescence during amplification, as known in the art.

Where the amplification product is to be used for hybridization to an array or microarray, a number of suitable commercially available amplification products are available. These include amplification kits available from NuGEN, Inc. (San Carlos, Calif.), including the WT-Ovation™ System, WT-Ovation™ System v2, WT-Ovation™ Pico System, WT-Ovation™ FFPE Exon Module, WT-Ovation™ FFPE Exon Module RiboAmp and RiboAmp$^{Plus}$ RNA Amplification Kits (MDS Analytical Technologies (formerly Arcturus) (Mountain View, Calif.), Genisphere, Inc. (Hatfield, Pa.), including the RampUp Plus™ and SenseAmp™ RNA Amplification kits, alone or in combination. Amplified nucleic acids may be subjected to one or more purification reactions after amplification and labeling, for example using magnetic beads (e.g., RNAClean magnetic beads, Agencourt Biosciences).

Multiple RNA biomarkers can be analyzed using real-time quantitative multiplex RT-PCR platforms and other multiplexing technologies such as GenomeLab GeXP Genetic Analysis System (Beckman Coulter, Foster City, Calif.), SmartCycler® 9600 or GeneXpert® Systems (Cepheid, Sunnyvale, Calif.), ABI 7900 HT Fast Real Time PCR system (Applied Biosystems, Foster City, Calif.), LightCycler® 480 System (Roche Molecular Systems, Pleasanton, Calif.), xMAP 100 System (Luminex, Austin, Tex.) Solexa Genome Analysis System (Illumina, Hayward, Calif.), OpenArray Real Time qPCR (BioTrove, Woburn, Mass.) and BeadXpress System (Illumina, Hayward, Calif.).

Detection and/or Quantification of Target Sequences

Any method of detecting and/or quantitating the expression of the encoded target sequences can in principle be used in the invention. The expressed target sequences can be directly detected and/or quantitated, or may be copied and/or amplified to allow detection of amplified copies of the expressed target sequences or its complement.

Methods for detecting and/or quantifying a target can include Northern blotting, sequencing, array or microarray hybridization, serial analysis of gene expression (SAGE), by enzymatic cleavage of specific structures (e.g., an Invader® assay, Third Wave Technologies, e.g. as described in U.S. Pat. Nos. 5,846,717, 6,090,543; 6,001,567; 5,985,557; and 5,994,069) and amplification methods, e.g. RT-PCR, including in a TaqMan® assay (PE Biosystems, Foster City, Calif., e.g. as described in U.S. Pat. Nos. 5,962,233 and 5,538,848), and may be quantitative or semi-quantitative, and may vary depending on the origin, amount and condition of the available biological sample. Combinations of these methods may also be used. For example, nucleic acids may be amplified, labeled and subjected to microarray analysis.

In some instances, target sequences may be detected by sequencing. Sequencing methods may comprise whole genome sequencing or exome sequencing. Sequencing methods such as Maxim-Gilbert, chain-termination, or high-throughput systems may also be used. Additional, suitable sequencing techniques include classic dideoxy sequencing reactions (Sanger method) using labeled terminators or primers and gel separation in slab or capillary, sequencing by synthesis using reversibly terminated labeled nucleotides, pyrosequencing, 454 sequencing, allele specific hybridization to a library of labeled oligonucleotide probes, sequencing by synthesis using allele specific hybridization to a library of labeled clones that is followed by ligation, real time monitoring of the incorporation of labeled nucleotides during a polymerization step, and SOLiD sequencing.

Additional methods for detecting and/or quantifying a target include single-molecule sequencing (e.g., Helicos, PacBio), sequencing by synthesis (e.g., Illumina, Ion Torrent), sequencing by ligation (e.g., ABI SOLID), sequencing by hybridization (e.g., Complete Genomics), in situ hybridization, bead-array technologies (e.g., Luminex xMAP, Illumina BeadChips), branched DNA technology (e.g., Panomics, Genisphere). Sequencing methods may use fluorescent (e.g., Illumina) or electronic (e.g., Ion Torrent, Oxford Nanopore) methods of detecting nucleotides.

Reverse Transcription for ORT-PCR Analysis

Reverse transcription can be performed by any method known in the art. For example, reverse transcription may be performed using the Omniscript kit (Qiagen, Valencia, Calif.), Superscript III kit (Invitrogen, Carlsbad, Calif.), for RT-PCR. Target-specific priming can be performed in order to increase the sensitivity of detection of target sequences and generate target-specific cDNA.

TanMan® Gene Expression Analysis

TaqMan®RT-PCR can be performed using Applied Biosystems Prism (ABI) 7900 HT instruments in a 5 1.11 volume with target sequence-specific cDNA equivalent to 1 ng total RNA.

Primers and probes concentrations for TaqMan analysis are added to amplify fluorescent amplicons using PCR cycling conditions such as 95° C. for 10 minutes for one cycle, 95° C. for 20 seconds, and 60° C. for 45 seconds for 40 cycles. A reference sample can be assayed to ensure reagent and process stability. Negative controls (e.g., no template) should be assayed to monitor any exogenous nucleic acid contamination.

Classification Arrays

The present invention contemplates that a probe set or probes derived therefrom may be provided in an array format. In the context of the present invention, an "array" is a spatially or logically organized collection of polynucleotide probes. An array comprising probes specific for a coding target, non-coding target, or a combination thereof may be used. Alternatively, an array comprising probes specific for two or more of transcripts of a target selected from Table 3, Table 5, Table 13 or SEQ ID Nos: 1-4050, or a product derived thereof, can be used. Desirably, an array may be specific for 5, 10, 15, 20, 25, 30 or more of transcripts of a target selected from Table 3, Table 5, Table 13 or SEQ ID Nos: 1-4050. Expression of these sequences may be detected alone or in combination with other transcripts. In some embodiments, an array is used which comprises a wide range of sensor probes for bladder-specific expression products, along with appropriate control sequences. In some instances, the array may comprise the Human Exon 1.0 ST Array (HuEx 1.0 ST, Affymetrix, Inc., Santa Clara, Calif.).

Typically the polynucleotide probes are attached to a solid substrate and are ordered so that the location (on the substrate) and the identity of each are known. The polynucleotide probes can be attached to one of a variety of solid substrates capable of withstanding the reagents and conditions necessary for use of the array. Examples include, but are not limited to, polymers, such as (poly)tetrafluoroethylene, (poly)vinylidenedifluoride, polystyrene, polycarbonate, polypropylene and polystyrene; ceramic; silicon; silicon dioxide; modified silicon; (fused) silica, quartz or glass; functionalized glass; paper, such as filter paper; diazotized cellulose; nitrocellulose filter; nylon membrane; and polyacrylamide gel pad. Substrates that are transparent to light are useful for arrays that may be used in an assay that involves optical detection.

Examples of array formats include membrane or filter arrays (for example, nitrocellulose, nylon arrays), plate arrays (for example, multiwell, such as a 24-, 96-, 256-, 384-, 864- or 1536-well, microtitre plate arrays), pin arrays, and bead arrays (for example, in a liquid "slurry"). Arrays on substrates such as glass or ceramic slides are often referred to as chip arrays or "chips." Such arrays are well known in the art. In one embodiment of the present invention, the Cancer Prognosticarray is a chip.

Data Analysis

In some embodiments, one or more pattern recognition methods can be used in analyzing the expression level of target sequences. The pattern recognition method can comprise a linear combination of expression levels, or a nonlinear combination of expression levels. In some embodiments, expression measurements for RNA transcripts or combinations of RNA transcript levels are formulated into linear or non-linear models or algorithms (e.g., an 'expression signature') and converted into a likelihood score. This likelihood score may indicate the probability that a biological sample is from a patient who will benefit from neoadjuvant chemotherapy. Additionally, a likelihood score may indicate the probability that a biological sample is from a patient who may exhibit no evidence of disease, who may exhibit systemic cancer, or who may exhibit biochemical recurrence. The likelihood score can be used to distinguish these disease states. The models and/or algorithms can be provided in machine readable format, and may be used to correlate expression levels or an expression profile with a disease state, and/or to designate a treatment modality for a patient or class of patients.

Assaying the expression level for a plurality of targets may comprise the use of an algorithm or classifier. Array data can be managed, classified, and analyzed using techniques known in the art. Assaying the expression level for a plurality of targets may comprise probe set modeling and data pre-processing. Probe set modeling and data pre-processing can be derived using the Robust Multi-Array (RMA) algorithm or variants GC-RMA, fRMA, Probe Logarithmic Intensity Error (PLIER) algorithm, or variant iterPLIER, or Single-Channel Array Normalization (SCAN) algorithm. Variance or intensity filters can be applied to pre-process data using the RMA algorithm, for example by removing target sequences with a standard deviation of <10 or a mean intensity of <100 intensity units of a normalized data range, respectively.

Alternatively, assaying the expression level for a plurality of targets may comprise the use of a machine learning algorithm. The machine learning algorithm may comprise a supervised learning algorithm. Examples of supervised learning algorithms may include Average One-Dependence Estimators (AODE), Artificial neural network (e.g., Back-propagation), Bayesian statistics (e.g., Naive Bayes classifier, Bayesian network, Bayesian knowledge base), Case-based reasoning, Decision trees, Inductive logic programming, Gaussian process regression, Group method of data handling (GMDH), Learning Automata, Learning Vector Quantization, Minimum message length (decision trees, decision graphs, etc.), Lazy learning, Instance-based learning Nearest Neighbor Algorithm, Analogical modeling, Probably approximately correct learning (PAC) learning, Ripple down rules, a knowledge acquisition methodology, Symbolic machine learning algorithms, Subsymbolic machine learning algorithms, Support vector machines, Random Forests, Ensembles of classifiers, Bootstrap aggregating (bagging), and Boosting. Supervised learning may comprise ordinal classification such as regression analysis and Information fuzzy networks (IFN). Alternatively, supervised learning methods may comprise statistical classification, such as AODE, Linear classifiers (e.g., Fisher's linear discriminant, Logistic regression, Naive Bayes classifier, Perceptron, and Support vector machine), quadratic classifiers, k-nearest neighbor, Boosting, Decision trees (e.g., C4.5, Random forests), Bayesian networks, and Hidden Markov models.

The machine learning algorithms may also comprise an unsupervised learning algorithm. Examples of unsupervised learning algorithms may include artificial neural network, Data clustering, Expectation-maximization algorithm, Self-organizing map, Radial basis function network, Vector Quantization, Generative topographic map, Information bottleneck method, and IBSEAD. Unsupervised learning may also comprise association rule learning algorithms such as Apriori algorithm, Eclat algorithm and FP-growth algorithm. Hierarchical clustering, such as Single-linkage clustering and Conceptual clustering, may also be used. Alternatively, unsupervised learning may comprise partitional clustering such as K-means algorithm and Fuzzy clustering.

In some instances, the machine learning algorithms comprise a reinforcement learning algorithm. Examples of reinforcement learning algorithms include, but are not limited to, temporal difference learning, Q-learning and Learning Automata. Alternatively, the machine learning algorithm may comprise Data Pre-processing.

Preferably, the machine learning algorithms may include, but are not limited to, Average One-Dependence Estimators (AODE), Fisher's linear discriminant, Logistic regression, Perceptron, Multilayer Perceptron, Artificial Neural Networks, Support vector machines, Quadratic classifiers, Boosting, Decision trees, C4.5, Bayesian networks, Hidden Markov models, High-Dimensional Discriminant Analysis, and Gaussian Mixture Models. The machine learning algorithm may comprise support vector machines, Naïve Bayes classifier, k-nearest neighbor, high-dimensional discriminant analysis, or Gaussian mixture models. In some instances, the machine learning algorithm comprises Random Forests.

Subtyping

Molecular subtyping is a method of classifying bladder cancer into one of multiple genetically-distinct categories, or subtypes. Each subtype responds differently to different kinds of treatments, and the presence of a particular subtype is predictive of, for example, chemoresistance, higher risk of recurrence, or good or poor prognosis for an individual. The inventors of the present invention discovered that classification of bladder cancer into four subtypes, including, basal, claudin-low, luminal-infiltrated, and luminal non-infiltrated subtypes is clinically useful for predicting patient outcome and response to neoadjuvant chemotherapy (see Examples). As described herein, each subtype has a unique molecular and clinical fingerprint. Differential expression analysis of one or more of the gene targets listed in Table 3, Table 5, Table 13 or SEQ ID Nos: 1-4050 allows for the identification of the molecular subtype of a bladder cancer. In some instances, the molecular subtyping methods of the present invention are used in combination with other biomarkers, like tumor grade and hormone levels, for analyzing the bladder cancer.

Prediction of Treatment Response to Neoadjuvant Chemotherapy

Bladder cancer subtyping can be utilized to predict whether or not a cancer patient will benefit from neoadjuvant chemotherapy. For example, patients with luminal, non-immune infiltrated tumors have the best prognosis, irrespective of the treatment strategy. Patients with luminal, immune-infiltrated tumors have a significantly worse prognosis than those with luminal non-infiltrated tumors with and without neoadjuvant chemotherapy. Patients with claudin-low tumors had the worst prognosis irrespective of treatment strategy. Patients with basal tumors derive the most benefit from neoadjuvant chemotherapy and have a poor prognosis compared to other subtypes when treated with surgery alone, but their prognosis dramatically improves with neoadjuvant chemotherapy. Thus, patients having the basal bladder cancer subtype benefit from neoadjuvant chemotherapy, whereas patients having other bladder cancer subtypes are better candidates for other anti-cancer treatment options.

Therapeutic Regimens

Diagnosing, predicting, or monitoring a status or outcome of bladder cancer may comprise treating the bladder cancer or preventing cancer progression. In addition, diagnosing, predicting, or monitoring a status or outcome of bladder cancer may comprise identifying or predicting which patients will be responders or non-responders to an anti-cancer therapy (e.g., neoadjuvant chemotherapy). In some instances, diagnosing, predicting, or monitoring may comprise determining a therapeutic regimen. Determining a therapeutic regimen may comprise administering an anti-cancer therapy. Alternatively, determining a therapeutic regimen may comprise modifying, recommending, continuing or discontinuing an anti-cancer regimen. In some instances, if the sample expression patterns are consistent with the expression pattern for a known disease or disease outcome, the expression patterns can be used to designate one or more treatment modalities (e.g., therapeutic regimens, such as neoadjuvant chemotherapy or other anti-cancer regimen). An anti-cancer regimen may comprise one or more anti-cancer therapies. Examples of anti-cancer therapies include surgery, chemotherapy, radiation therapy, immunotherapy/biological therapy, and photodynamic therapy.

For example, a patient is selected for treatment with neoadjuvant chemotherapy if the patient is identified as being likely to be responsive to neoadjuvant chemotherapy based on subtyping of the bladder cancer, as described herein. Neoadjuvant chemotherapy may be performed prior to other anti-cancer treatments such as, but not limited to, surgery (e.g., transurethral resection or cystectomy), radiation therapy, immunotherapy (e.g., *Bacillus* Calmette-Guerin (BCG) or anti-PDL1 immunotherapy), hormonal therapy, biologic therapy, or any combination thereof. Patients, especially those not identified as likely to benefit from neoadjuvant chemotherapy, may omit neoadjuvant chemotherapy and instead be administered other cancer treatments directly.

Examples of chemotherapeutic agents that may be used in treating bladder cancer include alkylating agents, anti-metabolites, plant alkaloids and terpenoids, vinca alkaloids, podophyllotoxin, taxanes, topoisomerase inhibitors, and cytotoxic antibiotics. Cisplatin, carboplatin, and oxaliplatin are examples of alkylating agents. Other alkylating agents include mechlorethamine, cyclophosphamide, chlorambucil, ifosfamide. Alkylating agents may impair cell function by forming covalent bonds with the amino, carboxyl, sulthydryl, and phosphate groups in biologically important molecules. Alternatively, alkylating agents may chemically modify a cell's DNA.

Anti-metabolites are another example of chemotherapeutic agents. Anti-metabolites may masquerade as purines or pyrimidines and may prevent purines and pyrimidines from becoming incorporated in to DNA during the "S" phase (of the cell cycle), thereby stopping normal development and division. Antimetabolites may also affect RNA synthesis. Examples of metabolites include azathioprine and mercaptopurine.

Alkaloids may be derived from plants and block cell division may also be used for the treatment of cancer. Alkyloids may prevent microtubule function. Examples of alkaloids are vinca alkaloids and taxanes. *Vinca* alkaloids may bind to specific sites on tubulin and inhibit the assembly of tubulin into microtubules (M phase of the cell cycle). The vinca alkaloids may be derived from the Madagascar periwinkle, *Catharanthus roseus* (formerly known as *Vinca rosea*). Examples of vinca alkaloids include, but are not limited to, vincristine, vinblastine, vinorelbine, or vindesine. Taxanes are diterpenes produced by the plants of the genus *Taxus* (yews). Taxanes may be derived from natural sources or synthesized artificially. Taxanes include paclitaxel (Taxol) and docetaxel (Taxotere). Taxanes may disrupt microtubule function. Microtubules are essential to cell division, and taxanes may stabilize GDP-bound tubulin in the microtubule, thereby inhibiting the process of cell division. Thus, in essence, taxanes may be mitotic inhibitors. Taxanes may also be radiosensitizing and often contain numerous chiral centers.

Alternative chemotherapeutic agents include podophyllotoxin. Podophyllotoxin is a plant-derived compound that may help with digestion and may be used to produce cytostatic drugs such as etoposide and teniposide. They may prevent the cell from entering the G1 phase (the start of DNA replication) and the replication of DNA (the S phase).

Topoisomerases are essential enzymes that maintain the topology of DNA. Inhibition of type I or type II topoisomerases may interfere with both transcription and replication of DNA by upsetting proper DNA supercoiling. Some chemotherapeutic agents may inhibit topoisomerases. For example, some type I topoisomerase inhibitors include camptothecins: irinotecan and topotecan. Examples of type II inhibitors include amsacrine, etoposide, etoposide phosphate, and teniposide.

Another example of chemotherapeutic agents is cytotoxic antibiotics. Cytotoxic antibiotics are a group of antibiotics that are used for the treatment of cancer because they may interfere with DNA replication and/or protein synthesis. Cytotoxic antibiotics include, but are not limited to, actinomycin, anthracyclines, doxorubicin, daunorubicin, valrubicin, idarubicin, epirubicin, bleomycin, plicamycin, and mitomycin.

Surgical oncology uses surgical methods to diagnose, stage, and treat cancer, and to relieve certain cancer-related symptoms. Surgery may be used to remove the tumor (e.g., excisions, resections, debulking surgery), reconstruct a part of the body (e.g., restorative surgery), and/or to relieve symptoms such as pain (e.g., palliative surgery). Surgery may also include cryosurgery. Cryosurgery (also called cryotherapy) may use extreme cold produced by liquid nitrogen (or argon gas) to destroy abnormal tissue. Cryosurgery can be used to treat external tumors, such as those on the skin. For external tumors, liquid nitrogen can be applied directly to the cancer cells with a cotton swab or spraying device. Cryosurgery may also be used to treat tumors inside the body (internal tumors and tumors in the bone). For internal tumors, liquid nitrogen or argon gas may be circulated through a hollow instrument called a cryoprobe, which is placed in contact with the tumor. An ultrasound or MRI may be used to guide the cryoprobe and monitor the freezing of the cells, thus limiting damage to nearby healthy tissue. A ball of ice crystals may form around the probe, freezing nearby cells. Sometimes more than one probe is used to deliver the liquid nitrogen to various parts of the tumor. The probes may be put into the tumor during surgery or through the skin (percutaneously). After cryosurgery, the frozen tissue thaws and may be naturally absorbed by the body (for internal tumors), or may dissolve and form a scab (for external tumors).

In some instances, the anti-cancer treatment may comprise radiation therapy. Radiation can come from a machine outside the body (external-beam radiation therapy) or from radioactive material placed in the body near cancer cells (internal radiation therapy, more commonly called brachytherapy). Systemic radiation therapy uses a radioactive substance, given by mouth or into a vein that travels in the blood to tissues throughout the body.

External-beam radiation therapy may be delivered in the form of photon beams (either x-rays or gamma rays). A photon is the basic unit of light and other forms of electromagnetic radiation. An example of external-beam radiation therapy is called 3-dimensional conformal radiation therapy (3D-CRT). 3D-CRT may use computer software and advanced treatment machines to deliver radiation to very precisely shaped target areas. Many other methods of external-beam radiation therapy are currently being tested and used in cancer treatment. These methods include, but are not limited to, intensity-modulated radiation therapy (IMRT), image-guided radiation therapy (IGRT), Stereotactic radiosurgery (SRS), Stereotactic body radiation therapy (SBRT), and proton therapy.

Intensity-modulated radiation therapy (IMRT) is an example of external-beam radiation and may use hundreds of tiny radiation beam-shaping devices, called collimators, to deliver a single dose of radiation. The collimators can be stationary or can move during treatment, allowing the intensity of the radiation beams to change during treatment sessions. This kind of dose modulation allows different areas of a tumor or nearby tissues to receive different doses of radiation. IMRT is planned in reverse (called inverse treatment planning). In inverse treatment planning, the radiation doses to different areas of the tumor and surrounding tissue are planned in advance, and then a high-powered computer program calculates the required number of beams and angles of the radiation treatment. In contrast, during traditional (forward) treatment planning, the number and angles of the radiation beams are chosen in advance and computers calculate how much dose may be delivered from each of the planned beams. The goal of IMRT is to increase the radiation dose to the areas that need it and reduce radiation exposure to specific sensitive areas of surrounding normal tissue.

Another example of external-beam radiation is image-guided radiation therapy (IGRT). In IGRT, repeated imaging scans (CT, MRI, or PET) may be performed during treatment. These imaging scans may be processed by computers to identify changes in a tumor's size and location due to treatment and to allow the position of the patient or the planned radiation dose to be adjusted during treatment as needed. Repeated imaging can increase the accuracy of radiation treatment and may allow reductions in the planned volume of tissue to be treated, thereby decreasing the total radiation dose to normal tissue.

Tomotherapy is a type of image-guided IMRT. A tomotherapy machine is a hybrid between a CT imaging scanner and an external-beam radiation therapy machine. The part of the tomotherapy machine that delivers radiation for both imaging and treatment can rotate completely around the patient in the same manner as a normal CT scanner. Tomotherapy machines can capture CT images of the patient's tumor immediately before treatment sessions, to allow for very precise tumor targeting and sparing of normal tissue.

Stereotactic radiosurgery (SRS) can deliver one or more high doses of radiation to a small tumor. SRS uses extremely accurate image-guided tumor targeting and patient positioning. Therefore, a high dose of radiation can be given without excess damage to normal tissue. SRS can be used to treat small tumors with well-defined edges. It is most commonly used in the treatment of brain or spinal tumors and brain metastases from other cancer types. For the treatment of some brain metastases, patients may receive radiation therapy to the entire brain (called whole-brain radiation therapy) in addition to SRS. SRS requires the use of a head frame or other device to immobilize the patient during treatment to ensure that the high dose of radiation is delivered accurately.

Stereotactic body radiation therapy (SBRT) delivers radiation therapy in fewer sessions, using smaller radiation fields and higher doses than 3D-CRT in most cases. SBRT may treat tumors that lie outside the brain and spinal cord. Because these tumors are more likely to move with the normal motion of the body, and therefore cannot be targeted as accurately as tumors within the brain or spine, SBRT is usually given in more than one dose. SBRT can be used to treat small, isolated tumors, including cancers in the lung and liver. SBRT systems may be known by their brand names, such as the CyberKnife®.

In proton therapy, external-beam radiation therapy may be delivered by proton. Protons are a type of charged particle. Proton beams differ from photon beams mainly in the way they deposit energy in living tissue. Whereas photons deposit energy in small packets all along their path through tissue, protons deposit much of their energy at the end of their path (called the Bragg peak) and deposit less energy along the way. Use of protons may reduce the exposure of normal tissue to radiation, possibly allowing the delivery of higher doses of radiation to a tumor.

Other charged particle beams such as electron beams may be used to irradiate superficial tumors, such as skin cancer or tumors near the surface of the body, but they cannot travel very far through tissue.

Internal radiation therapy (brachytherapy) is radiation delivered from radiation sources (radioactive materials) placed inside or on the body. Several brachytherapy techniques are used in cancer treatment. Interstitial brachytherapy may use a radiation source placed within tumor tissue, such as within a bladder tumor. Intracavitary brachytherapy may use a source placed within a surgical cavity or a body cavity, such as the chest cavity, near a tumor. Episcleral brachytherapy, which may be used to treat melanoma inside the eye, may use a source that is attached to the eye. In brachytherapy, radioactive isotopes can be sealed in tiny pellets or "seeds." These seeds may be placed in patients using delivery devices, such as needles, catheters, or some other type of carrier. As the isotopes decay naturally, they give off radiation that may damage nearby cancer cells. Brachytherapy may be able to deliver higher doses of radiation to some cancers than external-beam radiation therapy while causing less damage to normal tissue.

Brachytherapy can be given as a low-dose-rate or a high-dose-rate treatment. In low-dose-rate treatment, cancer cells receive continuous low-dose radiation from the source over a period of several days. In high-dose-rate treatment, a robotic machine attached to delivery tubes placed inside the body may guide one or more radioactive sources into or near a tumor, and then removes the sources at the end of each treatment session. High-dose-rate treatment can be given in one or more treatment sessions. An example of a high-dose-rate treatment is the MammoSite® system.

The placement of brachytherapy sources can be temporary or permanent. For permanent brachytherapy, the sources may be surgically sealed within the body and left there, even after all of the radiation has been given off. In some instances, the remaining material (in which the radioactive isotopes were sealed) does not cause any discomfort or harm to the patient. Permanent brachytherapy is a type of low-dose-rate brachytherapy. For temporary brachytherapy, tubes (catheters) or other carriers are used to deliver the radiation sources, and both the carriers and the radiation sources are removed after treatment. Temporary brachytherapy can be either low-dose-rate or high-dose-rate treatment. Brachytherapy may be used alone or in addition to external-beam radiation therapy to provide a "boost" of radiation to a tumor while sparing surrounding normal tissue.

In systemic radiation therapy, a patient may swallow or receive an injection of a radioactive substance, such as radioactive iodine or a radioactive substance bound to a monoclonal antibody. Radioactive iodine (131I) is a type of systemic radiation therapy commonly used to help treat cancer, such as thyroid cancer. Thyroid cells naturally take up radioactive iodine. For systemic radiation therapy for some other types of cancer, a monoclonal antibody may help target the radioactive substance to the right place. The antibody joined to the radioactive substance travels through the blood, locating and killing tumor cells. For example, the drug ibritumomab tiuxetan (Zevalin®) may be used for the treatment of certain types of B-cell non-Hodgkin lymphoma (NHL). The antibody part of this drug recognizes and binds to a protein found on the surface of B lymphocytes. The combination drug regimen of tositumomab and iodine I 131 tositumomab (Bexxar®) may be used for the treatment of certain types of cancer, such as NHL. In this regimen, nonradioactive tositumomab antibodies may be given to patients first, followed by treatment with tositumomab antibodies that have 131I attached. Tositumomab may recognize and bind to the same protein on B lymphocytes as ibritumomab. The nonradioactive form of the antibody may help protect normal B lymphocytes from being damaged by radiation from 131I.

Some systemic radiation therapy drugs relieve pain from cancer that has spread to the bone (bone metastases). This is a type of palliative radiation therapy. The radioactive drugs samarium-153-lexidronam (Quadramet®) and strontium-89 chloride (Metastron®) are examples of radiopharmaceuticals may be used to treat pain from bone metastases.

Photodynamic therapy (PDT) is an anti-cancer treatment that may use a drug, called a photosensitizer or photosensitizing agent, and a particular type of light. When photosensitizers are exposed to a specific wavelength of light, they may produce a form of oxygen that kills nearby cells. A photosensitizer may be activated by light of a specific wavelength. This wavelength determines how far the light can travel into the body. Thus, photosensitizers and wavelengths of light may be used to treat different areas of the body with PDT.

In the first step of PDT for cancer treatment, a photosensitizing agent may be injected into the bloodstream. The agent may be absorbed by cells all over the body but may stay in cancer cells longer than it does in normal cells. Approximately 24 to 72 hours after injection, when most of the agent has left normal cells but remains in cancer cells, the tumor can be exposed to light. The photosensitizer in the tumor can absorb the light and produces an active form of oxygen that destroys nearby cancer cells. In addition to directly killing cancer cells, PDT may shrink or destroy tumors in two other ways. The photosensitizer can damage blood vessels in the tumor, thereby preventing the cancer from receiving necessary nutrients. PDT may also activate the immune system to attack the tumor cells.

The light used for PDT can come from a laser or other sources. Laser light can be directed through fiber optic cables (thin fibers that transmit light) to deliver light to areas inside the body. For example, a fiber optic cable can be inserted through an endoscope (a thin, lighted tube used to look at tissues inside the body) into the lungs or esophagus to treat cancer in these organs. Other light sources include light-emitting diodes (LEDs), which may be used for surface tumors, such as skin cancer. PDT is usually performed as an outpatient procedure. PDT may also be repeated and may be used with other therapies, such as surgery, radiation, or chemotherapy.

Extracorporeal photopheresis (ECP) is a type of PDT in which a machine may be used to collect the patient's blood cells. The patient's blood cells may be treated outside the body with a photosensitizing agent, exposed to light, and then returned to the patient. ECP may be used to help lessen the severity of skin symptoms of cutaneous T-cell lymphoma that has not responded to other therapies. ECP may be used to treat other blood cancers, and may also help reduce rejection after transplants.

Additionally, photosensitizing agent, such as porfimer sodium or Photofrin®, may be used in PDT to treat or relieve the symptoms of esophageal cancer and non-small cell lung cancer. Porfimer sodium may relieve symptoms of esophageal cancer when the cancer obstructs the esophagus or when the cancer cannot be satisfactorily treated with laser therapy alone. Porfimer sodium may be used to treat non-small cell lung cancer in patients for whom the usual treatments are not appropriate, and to relieve symptoms in patients with non-small cell lung cancer that obstructs the airways. Porfimer sodium may also be used for the treatment of precancerous lesions in patients with Barrett esophagus, a condition that can lead to esophageal cancer.

Laser therapy may use high-intensity light to treat cancer and other illnesses. Lasers can be used to shrink or destroy tumors or precancerous growths. Lasers are most commonly used to treat superficial cancers (cancers on the surface of the body or the lining of internal organs) such as basal cell skin cancer and the very early stages of some cancers, such as cervical, penile, vaginal, vulvar, and non-small cell lung cancer.

Lasers may also be used to relieve certain symptoms of cancer, such as bleeding or obstruction. For example, lasers can be used to shrink or destroy a tumor that is blocking a patient's trachea (windpipe) or esophagus. Lasers also can be used to remove colon polyps or tumors that are blocking the colon or stomach.

Laser therapy is often given through a flexible endoscope (a thin, lighted tube used to look at tissues inside the body). The endoscope is fitted with optical fibers (thin fibers that transmit light). It is inserted through an opening in the body, such as the mouth, nose, anus, or vagina. Laser light is then precisely aimed to cut or destroy a tumor.

Laser-induced interstitial thermotherapy (LITT), or interstitial laser photocoagulation, also uses lasers to treat some cancers. LITT is similar to a cancer treatment called hyperthermia, which uses heat to shrink tumors by damaging or killing cancer cells. During LITT, an optical fiber is inserted into a tumor. Laser light at the tip of the fiber raises the temperature of the tumor cells and damages or destroys them. LITT is sometimes used to shrink tumors in the liver.

Laser therapy can be used alone, but most often it is combined with other treatments, such as surgery, chemotherapy, or radiation therapy. In addition, lasers can seal nerve endings to reduce pain after surgery and seal lymph vessels to reduce swelling and limit the spread of tumor cells.

Lasers used to treat cancer may include carbon dioxide ($CO_2$) lasers, argon lasers, and neodymium:yttrium-aluminum-garnet (Nd:YAG) lasers. Each of these can shrink or destroy tumors and can be used with endoscopes. $CO_2$ and argon lasers can cut the skin's surface without going into deeper layers. Thus, they can be used to remove superficial cancers, such as skin cancer. In contrast, the Nd:YAG laser is more commonly applied through an endoscope to treat internal organs, such as the uterus, esophagus, and colon. Nd:YAG laser light can also travel through optical fibers into specific areas of the body during LITT. Argon lasers are often used to activate the drugs used in PDT.

Immunotherapy (sometimes called, biological therapy, biotherapy, biologic therapy, or biological response modifier (BRM) therapy) uses the body's immune system, either directly or indirectly, to fight cancer or to lessen the side effects that may be caused by some cancer treatments. Immunotherapies include interferons, interleukins, colony-stimulating factors, monoclonal antibodies, vaccines, immune cell-based therapy, gene therapy, and nonspecific immunomodulating agents.

Interferons (IFNs) are types of cytokines that occur naturally in the body. Interferon alpha, interferon beta, and interferon gamma are examples of interferons that may be used in cancer treatment.

Like interferons, interleukins (ILs) are cytokines that occur naturally in the body and can be made in the laboratory. Many interleukins have been identified for the treatment of cancer. For example, interleukin-2 (IL-2 or aldesleukin), interleukin 7, and interleukin 12 have may be used as an anti-cancer treatment. IL-2 may stimulate the growth and activity of many immune cells, such as lymphocytes, that can destroy cancer cells.

Colony-stimulating factors (CSFs) (sometimes called hematopoietic growth factors) may also be used for the treatment of cancer. Some examples of CSFs include, but are not limited to, G-CSF (filgrastim) and GM-CSF (sargramostim). CSFs may promote the division of bone marrow stem cells and their development into white blood cells, platelets, and red blood cells. Bone marrow is critical to the body's immune system because it is the source of all blood cells. Because anticancer drugs can damage the body's ability to make white blood cells, red blood cells, and platelets, stimulation of the immune system by CSFs may benefit patients undergoing other anti-cancer treatment, thus CSFs may be combined with other anti-cancer therapies, such as chemotherapy.

Another type of immunotherapy includes monoclonal antibodies (MOABs or MoABs). These antibodies may be produced by a single type of cell and may be specific for a particular antigen. To create MOABs, a human cancer cells may be injected into mice. In response, the mouse immune system can make antibodies against these cancer cells. The mouse plasma cells that produce antibodies may be isolated and fused with laboratory-grown cells to create "hybrid" cells called hybridomas. Hybridomas can indefinitely produce large quantities of these pure antibodies, or MOABs. MOABs may be used in cancer treatment in a number of ways. For instance, MOABs that react with specific types of cancer may enhance a patient's immune response to the cancer. MOABs can be programmed to act against cell growth factors, thus interfering with the growth of cancer cells.

MOABs may be linked to other anti-cancer therapies such as chemotherapeutics, radioisotopes (radioactive substances), other biological therapies, or other toxins. When the antibodies latch onto cancer cells, they deliver these anti-cancer therapies directly to the tumor, helping to destroy it. MOABs carrying radioisotopes may also prove useful in diagnosing cancer.

Cancer vaccines are another form of immunotherapy. Cancer vaccines may be designed to encourage the patient's immune system to recognize cancer cells. Cancer vaccines may be designed to treat existing cancers (therapeutic vaccines) or to prevent the development of cancer (prophylactic vaccines). Therapeutic vaccines may be injected in a person after cancer is diagnosed. These vaccines may stop the growth of existing tumors, prevent cancer from recurring, or eliminate cancer cells not killed by prior treatments. Cancer vaccines given when the tumor is small may be able to eradicate the cancer. On the other hand, prophylactic vaccines are given to healthy individuals before cancer develops. These vaccines are designed to stimulate the immune system to attack viruses that can cause cancer. By targeting these cancer-causing viruses, development of certain cancers may be prevented. For example, cervarix and gardasil are vaccines to treat human papilloma virus and may prevent cervical cancer. Therapeutic vaccines may be used to treat bladder cancer. Cancer vaccines can be used in combination with other anti-cancer therapies.

Immune cell-based therapy is also another form of immunotherapy. Adoptive cell transfer may include the transfer of immune cells such as dendritic cells, T cells (e.g., cytotoxic T cells), or natural killer (NK) cells to activate a cytotoxic response or attack cancer cells in a patient. Autologous immune cell-based therapy involves the transfer of a patient's own immune cells after expansion in vitro.

Gene therapy is another example of a biological therapy. Gene therapy may involve introducing genetic material into a person's cells to fight disease. Gene therapy methods may improve a patient's immune response to cancer. For example, a gene may be inserted into an immune cell to enhance its ability to recognize and attack cancer cells. In another approach, cancer cells may be injected with genes that cause the cancer cells to produce cytokines and stimulate the immune system.

In some instances, biological therapy includes nonspecific immunomodulating agents. Nonspecific immunomodulating agents are substances that stimulate or indirectly augment the immune system. Often, these agents target key immune system cells and may cause secondary responses such as increased production of cytokines and immunoglobulins. Two nonspecific immunomodulating agents used in cancer treatment are bacillus Calmette-Guerin (BCG) and levamisole. BCG may be used in the treatment of superficial bladder cancer following surgery. BCG may work by stimulating an inflammatory, and possibly an immune, response. A solution of BCG may be instilled in the bladder. Levamisole is sometimes used along with fluorouracil (5-FU) chemotherapy in the treatment of stage III (Dukes' C) colon cancer following surgery. Levamisole may act to restore depressed immune function.

Target sequences can be grouped so that information obtained about the set of target sequences in the group can be used to make or assist in making a clinically relevant judgment such as a diagnosis, prognosis, or treatment choice.

A patient report is also provided comprising a representation of measured expression levels of a plurality of target sequences in a biological sample from the patient, wherein the representation comprises expression levels of target sequences corresponding to any one, two, three, four, five, six, eight, ten, twenty, thirty or more of the target sequences corresponding to a target selected from Table 3, Table 5, Table 13 or SEQ ID Nos: 1-4050, the subsets described herein, or a combination thereof. In some embodiments, the representation of the measured expression level(s) may take the form of a linear or nonlinear combination of expression levels of the target sequences of interest. The patient report may be provided in a machine (e.g., a computer) readable format and/or in a hard (paper) copy. The report can also include standard measurements of expression levels of said plurality of target sequences from one or more sets of patients with known disease status and/or outcome. The report can be used to inform the patient and/or treating physician of the expression levels of the expressed target sequences, the likely medical diagnosis and/or implications, and optionally may recommend a treatment modality for the patient.

Also provided are representations of the gene expression profiles useful for treating, diagnosing, prognosticating, and otherwise assessing disease. In some embodiments, these profile representations are reduced to a medium that can be automatically read by a machine such as computer readable media (magnetic, optical, and the like). The articles can also include instructions for assessing the gene expression profiles in such media. For example, the articles may comprise a readable storage form having computer instructions for comparing gene expression profiles of the portfolios of genes described above. The articles may also have gene expression profiles digitally recorded therein so that they may be compared with gene expression data from patient samples. Alternatively, the profiles can be recorded in different representational format. A graphical recordation is one such format. Clustering algorithms can assist in the visualization of such data.

III. Experimental

Below are examples of specific embodiments for carrying out the present invention. The examples are offered for illustrative purposes only, and are not intended to limit the scope of the present invention in any way.

Efforts have been made to ensure accuracy with respect to numbers used (e.g., amounts, temperatures, etc.), but some experimental error and deviation should, of course, be allowed for.

EXAMPLES

Example 1

Validation Study of Molecular Subtypes in Muscle-Invasive Bladder Cancer on Predicting Response and Survival Outcome to Neoadjuvant Chemotherapy Approximately 40% of patients with muscle-invasive bladder cancer respond to neoadjuvant cisplatin-based chemotherapy (NAC), an integral component of multimodal treatment for this highly lethal disease. Only these responders appear to gain a survival advantage from NAC, while the remaining 60% face the risk for adverse effects and a delay in definitive surgery without clinical benefit. Identification of likely responders is essential to achieve a more precise delivery of care.

The significance of four subtyping methods in muscle-invasive bladder cancer in the context of neoadjuvant cisplatin-based chemotherapy (NAC) was examined as follows. The outcome of NAC treated patients was compared to patients in TCGA who did not receive NAC. Patients with basal tumors showed the most marked improvement in overall survival when treated with NAC. The prognosis of patients with other tumor subtypes did not change significantly without or with NAC. A single sample consensus genomic subtyping classifier was developed based on biological data and had potential clinical significance. This classifier included claudin-low, basal, luminal-infiltrated and luminal subtypes. Importantly, the classifier was able to generate subtype calls and the prognostic significance could be validated in independent retrospectively acquired non-NAC and NAC datasets.

Patient Populations

For the discovery NAC cohort, 223 patients from five institutions were selected. In all patients MIBC was diagnosed by TUR prior to receiving at least 3 cycles of NAC. Variant histology other than glandular or squamous differentiation was excluded. Most patients (67%) received gemcitabine/cisplatin (GC), 24% received methotrexate, vinblastine, adriamycin and cisplatin (MVAC) and 9% received gemcitabine/carboplatin (GCa).

For the validation NAC cohort, 82 patients from two institutions were selected whose characteristics were similar to those of the discovery set. GC was administered in 63% patients, MVAC in 13%, GCa in 6%, and other regimens in 12%. In total, 69 patients had received cisplatin-based NAC. All patients underwent radical cystectomy.

For outcome and survival analysis in both cohorts, only patients that received cisplatin-based NAC were used. In patients with clinical suspicion of diseased lymph nodes chemotherapy might have been administered rather in an inductive than a neoadjuvant manner. We use the term neoadjuvant chemotherapy for all patients with chemotherapy in a curative intent and that underwent cystectomy thereafter. Importantly, also only those patients were used for outcome and survival analysis in both cohorts (discovery: n=200, validation: n=69).

All cystectomy and lymphadenectomy specimens were staged according to the seventh International Union Against Cancer classification of 2009 at each study site (Sobin L H W C. TNM Atlas: 7th ed. New York: Wiley-Lyss Inc. TNM Atlas; 2009). At cystectomy, major response to NAC was defined as absence of muscle-invasive disease and lymph node metastases (<pT2 and pN0) Follow up of all patients was performed according to routine practices at each study site. In general, follow-up with cross sectional imaging was conducted at 3 and 6 months postoperatively, then at 6-month intervals until 5 years and yearly thereafter.

Tissue Sampling and Gene Expression Profiling

After pathologic review, tissue was harvested from formalin-fixed, paraffin-embedded tumor blocks by 1 mm punch under RNAse-free conditions. Total RNA was extracted and purified using RNeasy FFPE kit (Qiagen, Valencia, Calif.). RNA was amplified and labeled using the Ovation WTA FFPE system (NuGen, San Carlos, Calif.) and hybridized to GeneChip Human Exon 1.0 ST oligonucleotide microarrays (Affymetrix, Santa Clara, Calif.) according to the manufacturer's recommendations. Human Exon arrays use over 1.4 million probe selection regions (PSRs) to interrogate exons throughout the genome. In total 223/250 (89%) and 82/93 (88%) of the discovery and validation NAC cohorts, respectively, passed QC. Microarray data was normalized and gene summarized using Single-Channel Array Normalization (SCAN, Piccolo et al. (2012) *Genomics* 100(6): 337-344).

Three datasets from the public domain were used for additional clinical validation. For investigation of the prognostic impact, the 397 patients without chemotherapy prior to sample collection were used. Because an unknown proportion may have subsequently received NAC, validation of the discovered single sample classifier was only performed in those 179 without chemotherapy prior to sample collection and without adjuvant chemotherapy. In addition, for the validation of the newly discovered classifier in non-NAC patients, the datasets from MD Anderson Cancer Center and Lund University were downloaded from Gene Expression Omnibus database. These two datasets contained 107 and 190 patients, respectively with invasive bladder cancer who did not receive NAC.

Assignment to Subtypes

In the NAC dataset, ComBat (Johnson et al. (2007) *Biostatistics* 8(1): 118-127) was used to reduce the batch effect from the array data in the discovery and the validation datasets. Median centered expression data on gene level was used to generate the calls for each subtype.

The group from Lund (G.S.) provided the centroid values for each subtype of their original model (Sjodahl et al. (2012) *Clin. Cancer Res.* 18(12):3377-3386). Of the original model, 902/1038 genes are annotated in the Affymetrix HuEx array. As previously described, highest pearson correlation to the centroids of this model was used to assign the tumors to SCC-like, urobasal B (Uro B), infiltrated, urobasal A (Uro A) and genomically unstable (GU) respectively.

A classification to nearest centroids (ClaNC) model was used to assign the tumors to the TCGA clusters (Cancer Genome Atlas Research Network *Nature* 2014; 507(7492): 315-d22). Of the original model only 702/720 genes are annotated in the Affymetrix HuEx array data. Therefore, a reduced model (ClaNC702) was trained in the original TCGA data provided by K.A.H. to generate the assignment to the TCGA clusters.

The group from UNC (W. K. and J. K.) provided the classifiers to assign UNC subtypes (Damrauer et al. (2014) *Proc. Natl. Acad. Sci. USA* 111(8):3110-3115). Pearson correlation to each of the BASE47 cluster centroids was used to generate distances for class calls to accommodate for differences in platforms (Illumina versus Affymetrix HuEx Arrays). The claudin-low classifier assigned the basal tumors to claudin-low versus others (Kardos et al., supra).

The MDA subtypes were generated using the one nearest neighbor (oneNN) prediction model provided by the developer (D. M. and W. C). Of the original model 1990/2249 genes are annotated in the Affymetrix HuEx array. As previously described by Choi et al. (Cancer Cell (2014) 25(2):152-165), the tumors were assigned to basal, p53-like and luminal.

Gene Signature Expression Analysis (GSEA)

GSEA software was used to generate enrichment plots and calculate significance of gene signatures (broad.mit.edu/gsea/, Subramanian et al. (2005) Proc. Natl. Acad. Sci. USA 102(43):15545-15550). Genes were ranked with Signal2Noise and a weighted enrichment statistic was used to calculate Normalized Enrichment Scores, p-values and false detection rate.

Discovery and Validation of the Single Sample Classifier

A single sample model was trained to predict subtypes (Genomic Subtyping Classifier, GSC) using all pre-NAC TUR samples that passed QC, irrespective of chemotherapy regimen (n=223). The model was trained to predict four classes (claudin-low, basal, luminal-infiltrated and luminal). The labels in the training set were determined as follows: tumors were first classified as basal or luminal according to the UNC classifier. Claudin-low tumors were labeled within the UNC basal tumors. UNC luminal tumors that were not TCGA cluster II were labeled luminal and those that were TCGA cluster II were labeled luminal-infiltrated.

To make the model applicable to several platforms, only genes on both Illumina HumanHT-12 V3.0 and Affymetrix Human Exon array 1.0 ST were selected as the initial gene list (17,007 genes). Using this initial gene set, the model development framework consisted of: 1) Feature selection, by which genes with low variance (variance <0.2) were removed, and significant genes were selected (p<0.001) using Kruskal-Wallis rank sum test; 2) Model training with a generalized linear model with elastic net regularization (GLMNET) using the significant genes. These two steps were assessed using 10-fold cross-validation. Using the full training set, the feature selection step resulted in 287 genes, which were used to train the GSC. GLMNET finally selected 149 genes to produce four scores. These scores, each ranging from 0 to 1, indicate the likelihood of the sample belonging to each of the four subtypes. The GSC was independently validated in our 82 patient NAC validation dataset as well as in the three non-NAC cohorts from the public domain (see above).

Statistical Analyses

Statistical analyses were conducted using R Software Package, version 3.2.1. All tests were two-sided with type I error probability of 5%. Discrimination abilities of classifiers were compared using area under the curve (AUC) on the receiver-operating characteristic (ROC) curves. For analysis of pathological response and overall survival after NAC, only patients receiving cisplatin-based NAC (i.e. GC or MVAC) and subsequently undergoing cystectomy were evaluated (n=269). Univariable (UVA) and multivariable analysis (MVA) adjusting for clinical tumor stage, age, gender and institution were performed using logistic regression when studying pathological response to NAC. Kaplan-Meier plots were used to estimate overall survival (OS) from the date of surgery and comparisons were made using the log-rank test. Patients who were lost to follow-up were censored at the date of last contact. Cox proportional hazards regression models were used to estimate the effect of GSC on survival in a multivariable setting. In non-NAC set, the MVA adjusted for age and gender, while in NAC set, clinical tumor stage, age, gender and institution were adjusted for. Bladder cancer specific mortality data were only available from five cohorts and therefore not evaluated in this analysis.

Results

Clinicopathological details of the discovery and validation NAC meta-datasets are provided below in Table 1 and Table 2.

TABLE 1

| Patient Characteristics table of the cisplatin-based NAC set (n = 269) | | | | | | | | | | |
|---|---|---|---|---|---|---|---|---|---|---|
| Variable | | Bern | NKI | UHS | UW | VGH | UCD* | EMC* | Total | p-value |
| n | | 40 | 49 | 22 | 41 | 48 | 26 | 43 | 269 | |
| Overall Survival Time (Censored Patients) | Median (IQR) | 48 (26-73) | 46 (31-87) | 49 (40-59) | 48 (26-61) | 31 (13-41) | 9 (4-23) | 24 (13-36) | 27 (11-49) | — |
| Age | (mean (sd)) | 64 (10) | 57 (11) | 67 (12) | 62 (11) | 61 (9) | 65 (8) | 59 (13) | 61 (11) | — |
| Gender (%) | Female | 12 (30.0) | 17 (34.7) | 7 (31.8) | 10 (24.4) | 14 (29.2) | 8 (30.8) | 12 (27.9) | 80 (29.7) | 0.97 |
| | Male | 28 (70.0) | 32 (65.3) | 15 (68.2) | 31 (75.6) | 34 (70.8) | 18 (69.2) | 31 (72.1) | 189 (70.3) | |
| Clinical tumor stage (%) | T1 | 1 (2.5) | 0 (0.0) | 0 (0.0) | 0 (0.0) | 0 (0.0) | 0 (0.0) | 0 (0.0) | 1 (0.4) | <0.001 |
| | T2 | 4 (10.0) | 10 (20.4) | 18 (81.8) | 20 (48.8) | 26 (54.2) | 25 (96.2) | 17 (39.5) | 120 (44.6) | |
| | T3 | 21 (52.5) | 26 (53.1) | 4 (18.2) | 13 (31.7) | 19 (39.6) | 1 (3.8) | 18 (41.9) | 102 (37.9) | |
| | T4 | 14 (35.0) | 13 (26.5) | 0 (0.0) | 8 (19.5) | 3 (6.2) | 0 (0.0) | 4 (9.3) | 42 (15.6) | |
| | NA | 0 (0.0) | 0 (0.0) | 0 (0.0) | 0 (0.0) | 0 (0.0) | 0 (0.0) | 4 (9.3) | 4 (1.5) | |

TABLE 1-continued

Patient Characteristics table of the cisplatin-based NAC set (n = 269)

| Variable | | Bern | NKI | UHS | UW | VGH | UCD* | EMC* | Total | p-value |
|---|---|---|---|---|---|---|---|---|---|---|
| Clinical lymph node stage (%) | N0 | 14 (35.0) | 21 (42.9) | 20 (90.9) | 33 (80.5) | 38 (79.2) | 0 (0.0) | 32 (74.4) | 158 (58.7) | — |
| | N1-3 | 26 (65.0) | 28 (57.1) | 2 (9.1) | 8 (19.5) | 10 (20.8) | 0 (0.0) | 7 (16.3) | 81 (30.1) | |
| | NA | 0 (0.0) | 0 (0.0) | 0 (0.0) | 0 (0.0) | 0 (0.0) | 26 (100.0) | 4 (9.3) | 30 (11.2) | |
| Pathologic tumor stage (%) | pT0/is/a | 13 (32.5) | 24 (49.0) | 9 (40.9) | 18 (43.9) | 19 (39.6) | 9 (34.6) | 13 (30.2) | 105 (39.0) | 0.618 |
| | pT1 | 3 (7.5) | 2 (4.1) | 0 (0.0) | 5 (12.2) | 2 (4.2) | 2 (7.7) | 6 (14.0) | 20 (7.4) | |
| | pT2 | 8 (20.0) | 7 (14.3) | 5 (22.7) | 6 (14.6) | 13 (27.1) | 3 (11.5) | 5 (11.6) | 47 (17.5) | |
| | PT3/4 | 16 (40.0) | 15 (30.6) | 8 (36.4) | 12 (29.3) | 14 (29.2) | 11 (42.3) | 18 (41.9) | 94 (34.9) | |
| | NA | 0 (0.0) | 1 (2.0) | 0 (0.0) | 0 (0.0) | 0 (0.0) | 1 (3.8) | 1 (2.3) | 3 (1.1) | |
| Pathologic lymph node stage (%) | pN0 | 24 (60.0) | 28 (57.1) | 18 (81.8) | 33 (80.5) | 41 (85.4) | 16 (61.5) | 35 (81.4) | 195 (72.5) | 0.04 |
| | pN1-3 | 16 (40.0) | 12 (24.5) | 4 (18.2) | 8 (19.5) | 6 (12.5) | 8 (30.8) | 7 (16.3) | 61 (22.7) | |
| | NA | 0 (0.0) | 9 (18.4) | 0 (0.0) | 0 (0.0) | 1 (2.1) | 2 (7.7) | 1 (2.3) | 13 (4.8) | |
| NAC Type (%) | GemCis | 40 (100.0) | 16 (32.7) | 22 (100.0) | 22 (53.7) | 48 (100.0) | 19 (73.1) | 33 (76.7) | 200 (74.3) | <0.001 |
| | MVAC | 0 (0.0) | 33 (67.3) | 0 (0.0) | 19 (46.3) | 0 (0.0) | 6 (23.1) | 5 (11.6) | 63 (23.4) | |
| | Other | 0 (0.0) | 0 (0.0) | 0 (0.0) | 0 (0.0) | 0 (0.0) | 1 (3.8) | 5 (11.6) | 6 (2.2) | |

TABLE 2

Comparison of patient characteristics from NAC discovery and validation sets

| Variable | | Discovery 223 | Validation 82 | p-value Fisher's Test |
|---|---|---|---|---|
| Overall Survival Time (Censored Patients) | Median (IQR) | 41 (24-64) | 18 (7-35) | — |
| Age | (mean (sd)) | 62 (11) | 62 (11) | — |
| Gender (%) | Female | 69 (30.9) | 21 (25.6) | 0.445 |
| | Male | 154 (69.1) | 61 (74.4) | |
| Clinical Stage (%) | T1 | 1 (0.4) | 0 (0.0) | <0.001 |
| | T2 | 89 (39.9) | 53 (64.6) | |
| | T3 | 90 (40.4) | 19 (23.2) | |
| | T4 | 43 (19.3) | 6 (7.3) | |
| | NA | 0 (0.0) | 4 (4.9) | |
| Clinical node (%) | 0 | 140 (62.8) | 33 (40.2) | — |
| | 1 | 83 (37.2) | 8 (9.8) | |
| | NA | 0 (0.0) | 41 (50.0) | |
| Pathologic Stage (%) | pT0/is/a | 90 (40.4) | 25 (30.5) | 0.274 |
| | pT1 | 13 (5.8) | 8 (9.8) | |
| | pT2 | 42 (18.8) | 12 (14.6) | |
| | pT3/4 | 74 (33.2) | 35 (42.7) | |
| | NA | 4 (1.8) | 2 (2.4) | |
| Lymph Node Involvement (%) | Negative | 157 (70.4) | 61 (74.4) | 0.631 |
| | Positive | 52 (23.3) | 18 (22.0) | |
| | NA | 14 (6.3) | 3 (3.7) | |
| NAC Type (%) | GemCis | 149 (66.8) | 52 (63.4) | <0.001 |
| | MVAC | 54 (24.2) | 11 (13.4) | |
| | GemCarbo | 20 (9.0) | 5 (6.1) | |
| | Other | 0 (0.0) | 9 (11.0) | |
| | NA | 0 (0.0) | 5 (6.1) | |
| GSC (%) | Luminal | 90 (40.4) | 37 (45.1) | 0.123 |
| | Inf-Luminal | 33 (14.8) | 6 (7.3) | |
| | Basal | 53 (23.8) | 25 (30.5) | |
| | Claudin-Low | 47 (21.1) | 14 (17.1) | |

Subtyping Calls of the Models in the Discovery NAC Dataset

Figure 1B:
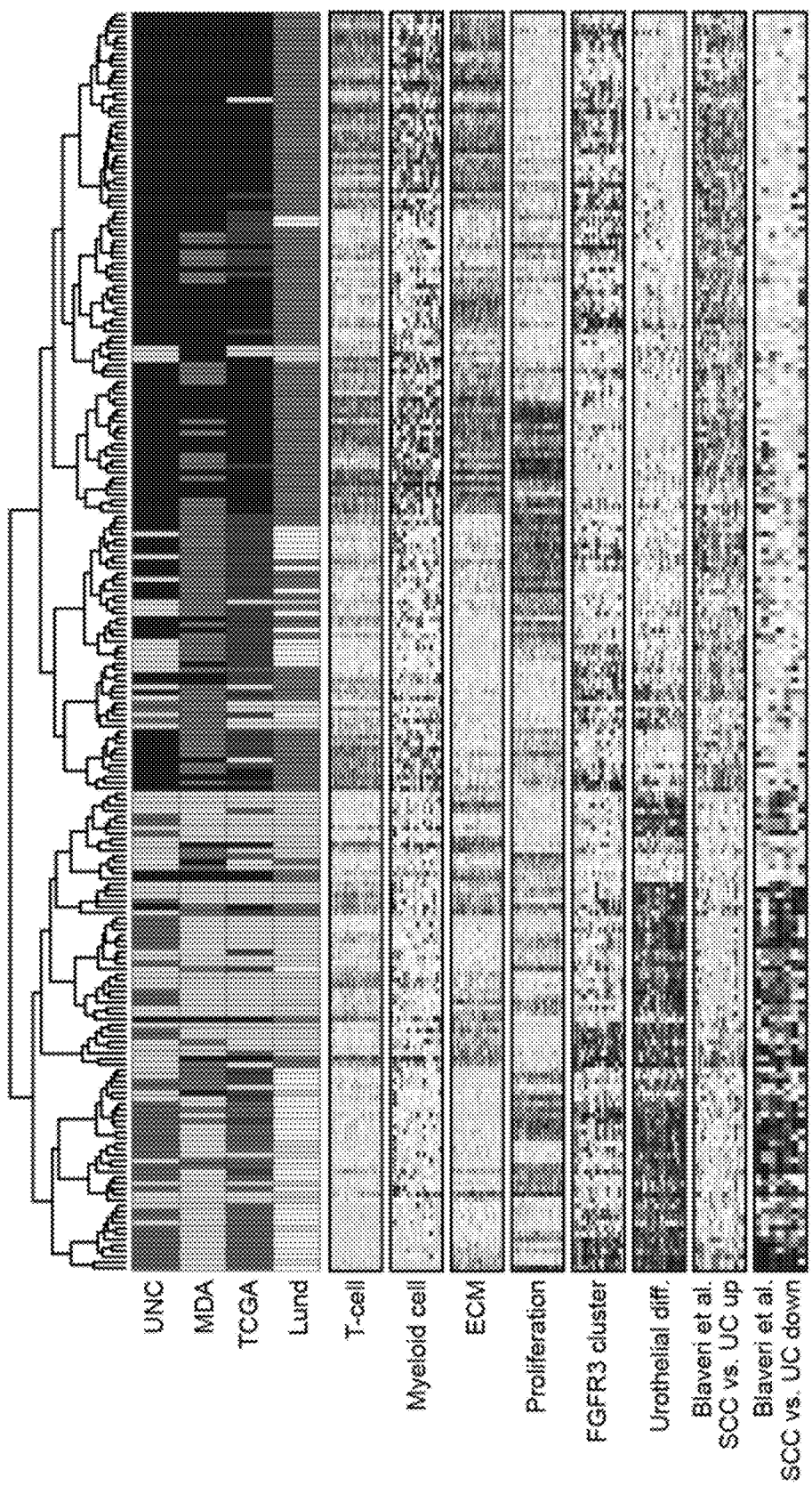
Figure 1C:
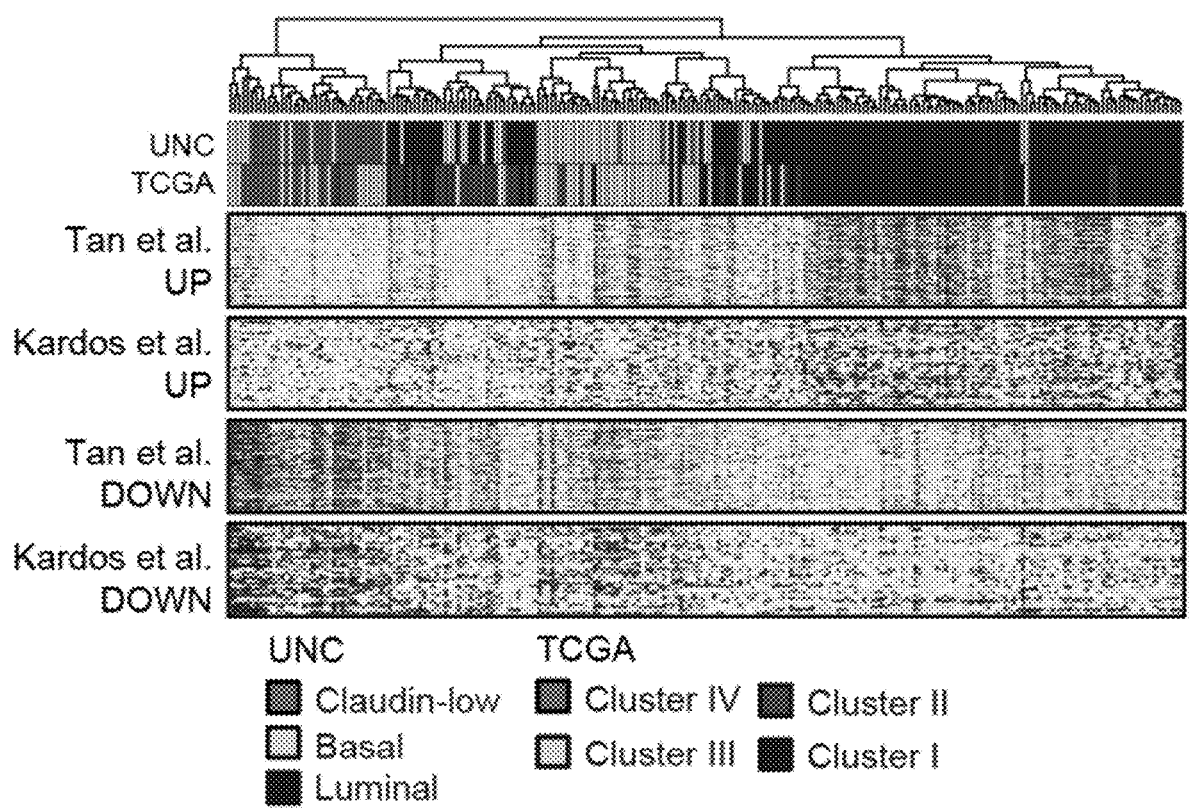
Figure 1D:
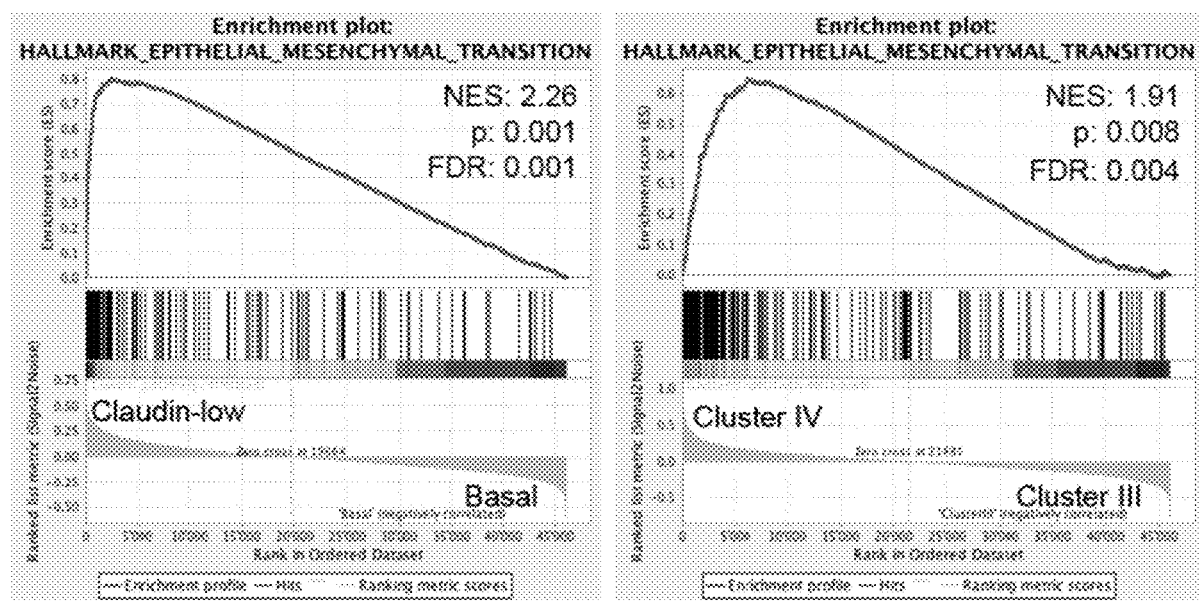
Figure 1E:
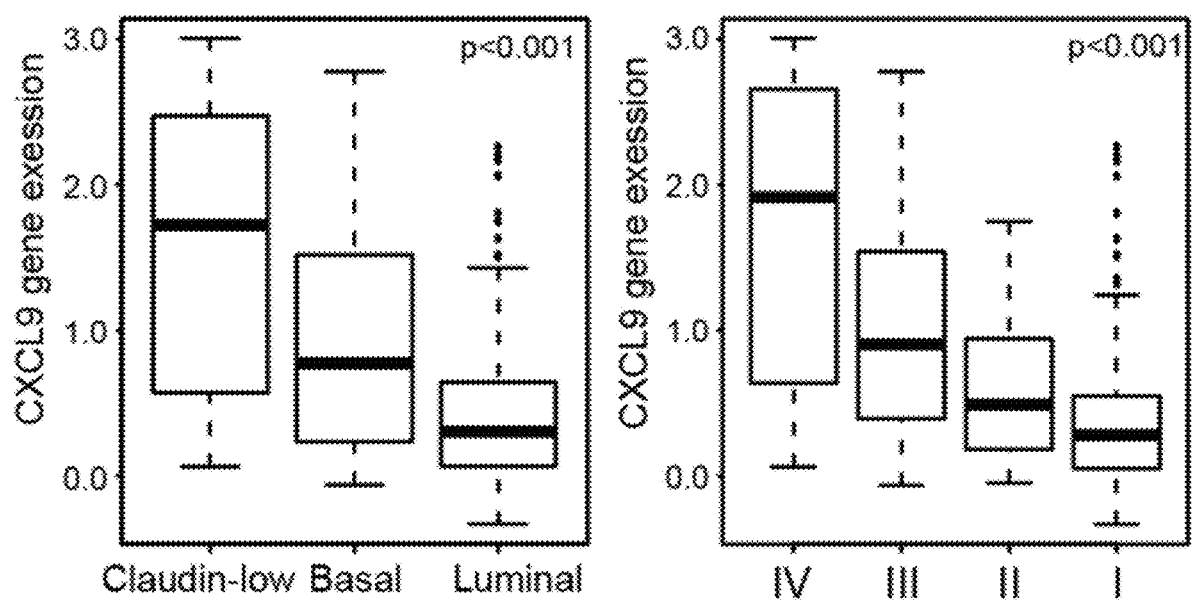
Figure 5:
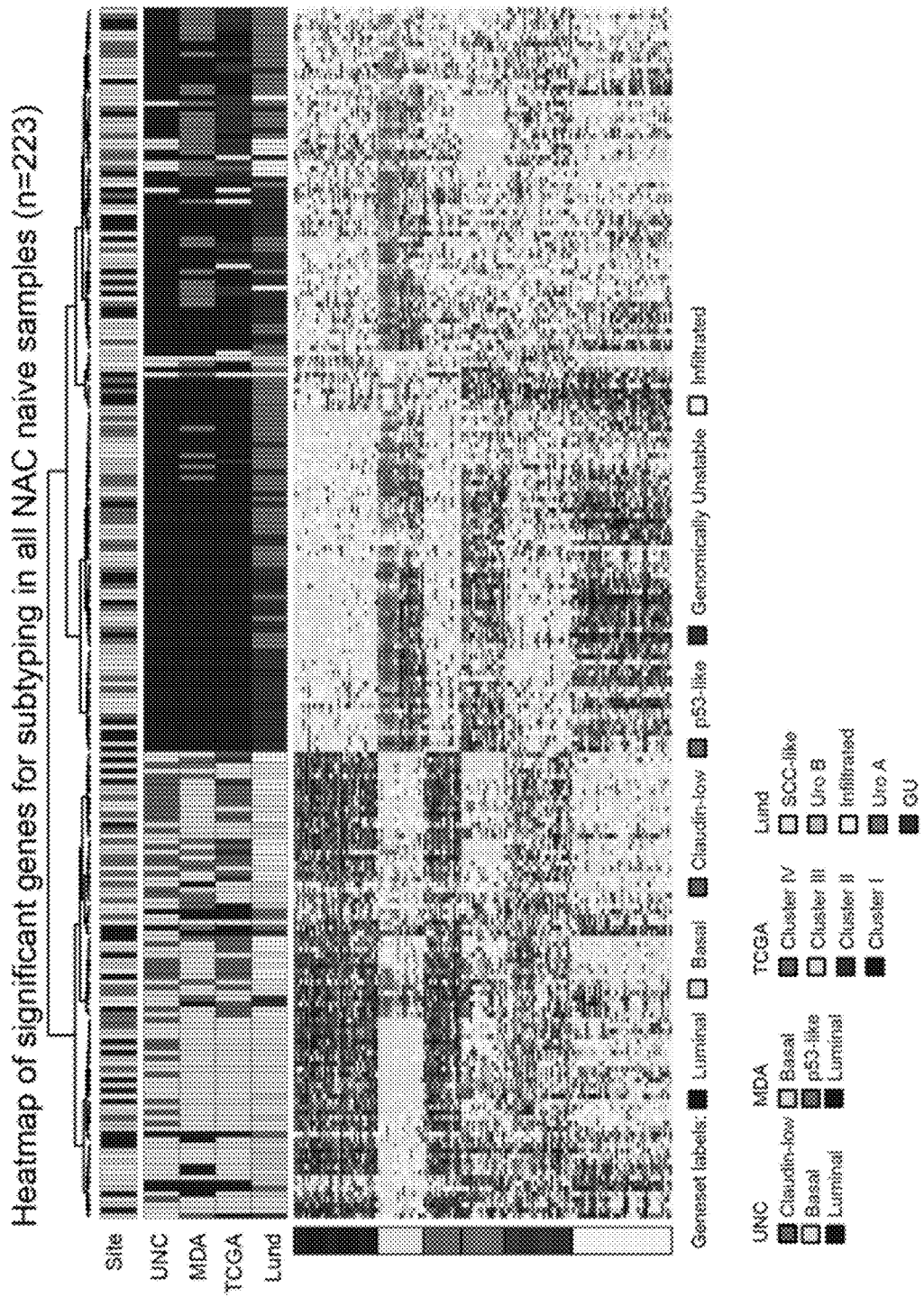
FIG. 5 shows a heatmap of gene signatures important for subtype calls.
Figure 6A:
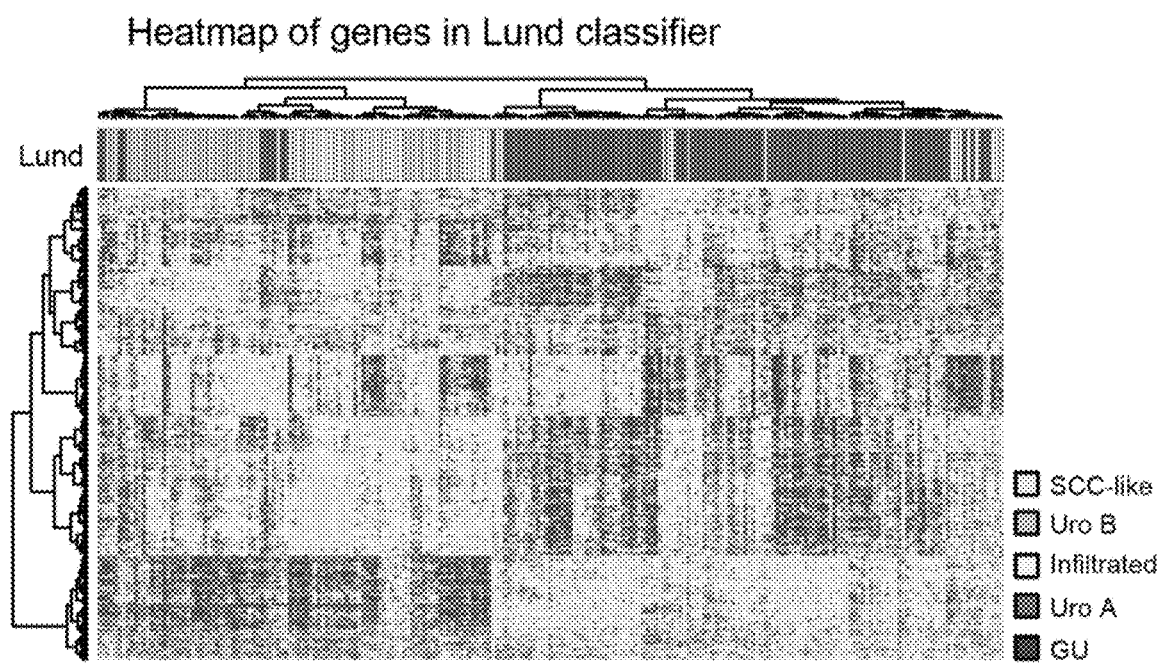
FIGS. 6A-6D show an analysis of the Lund and TCGA classifiers.
Figure 6B:
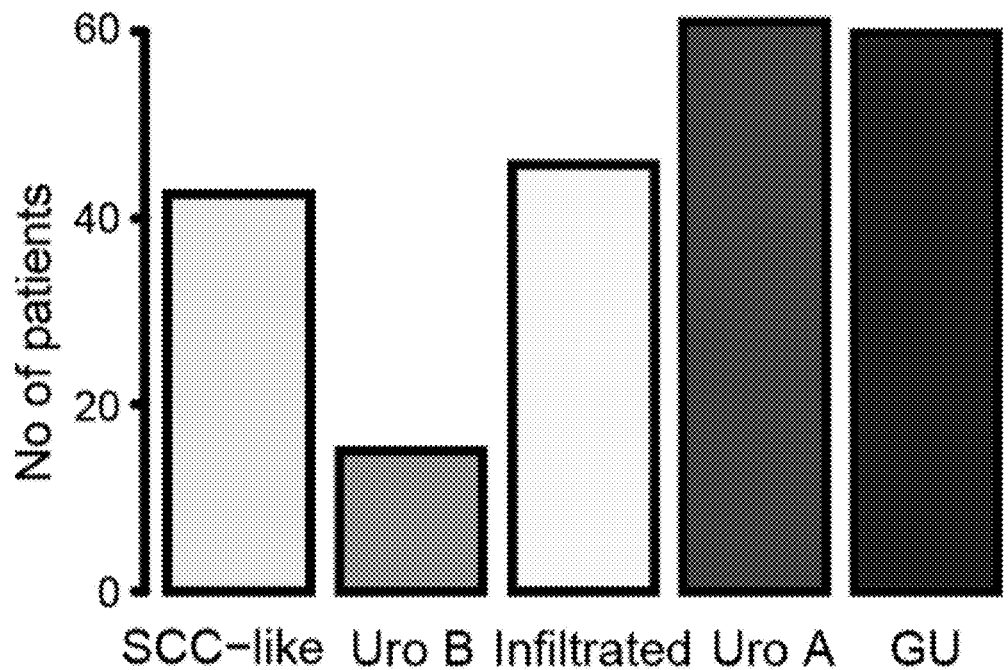
Figure 6C:
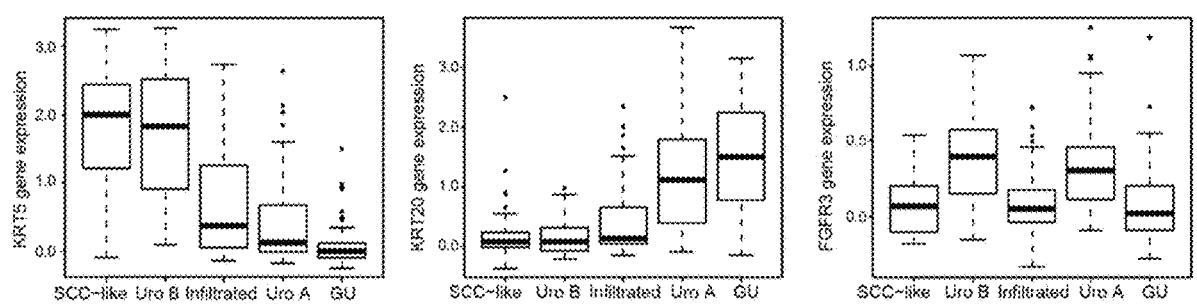
Figure 6D:
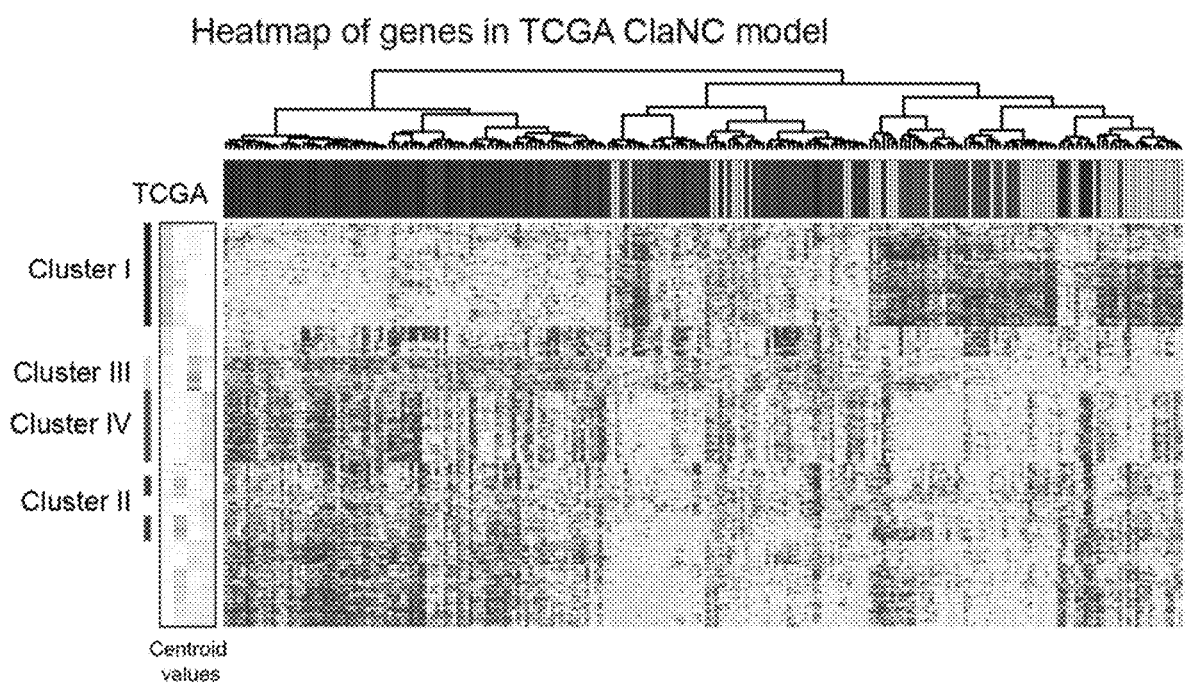
Figure 7A:
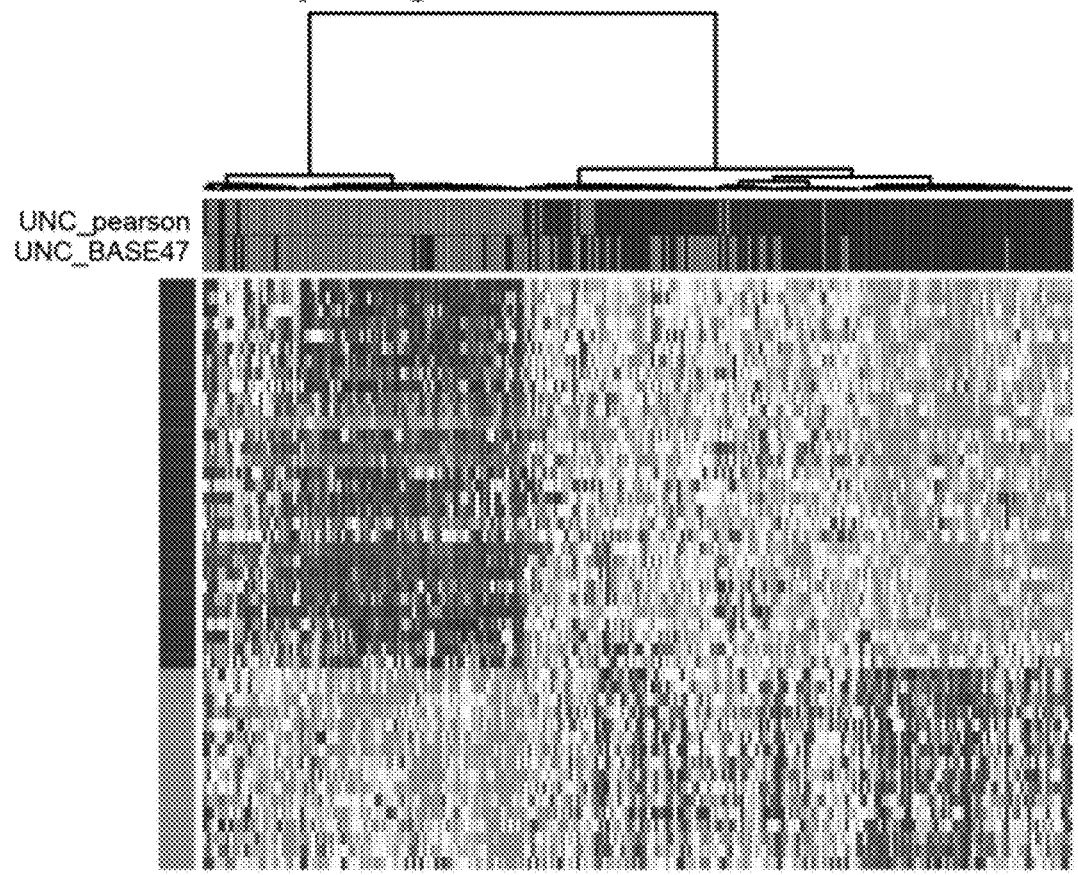
FIGS. 7A-7F show an analysis of the UNC and MDA classifiers.
Figure 7B:
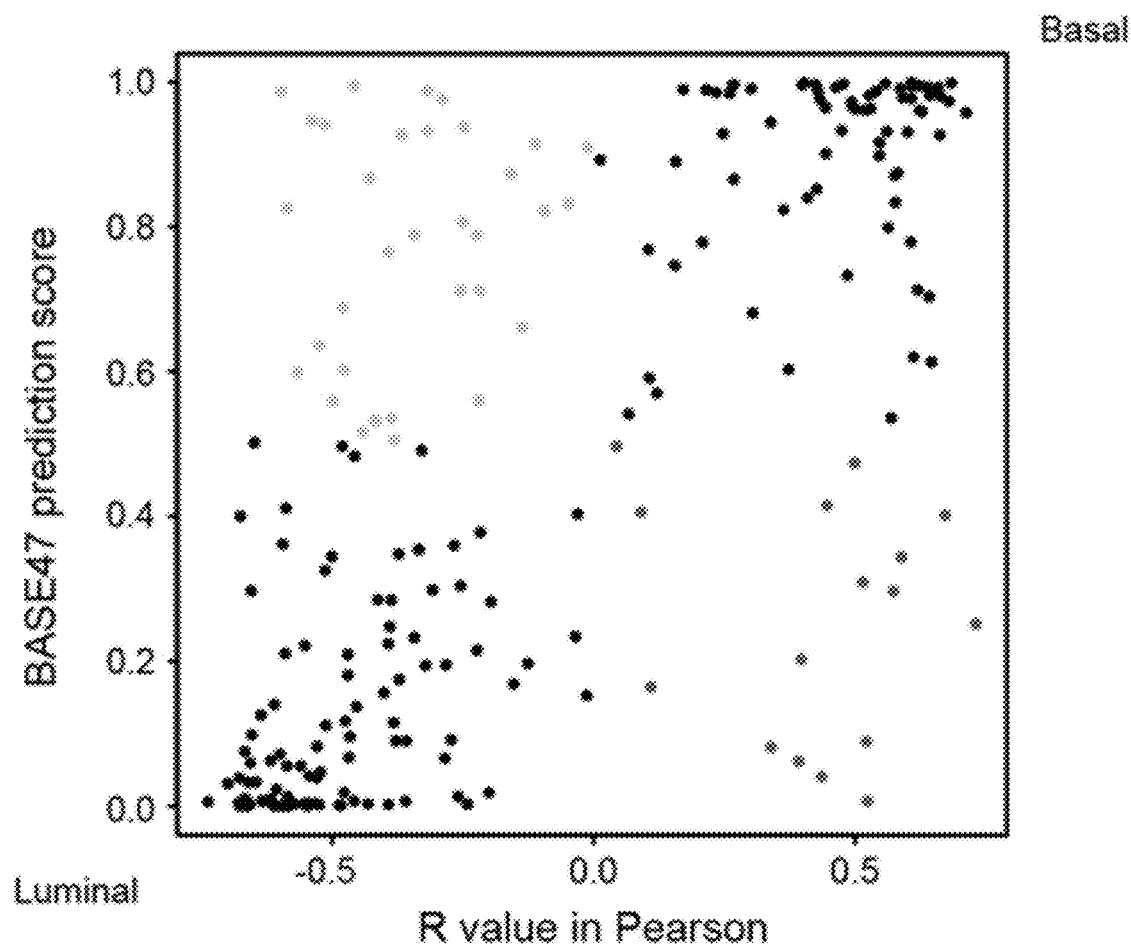
Figure 7C:
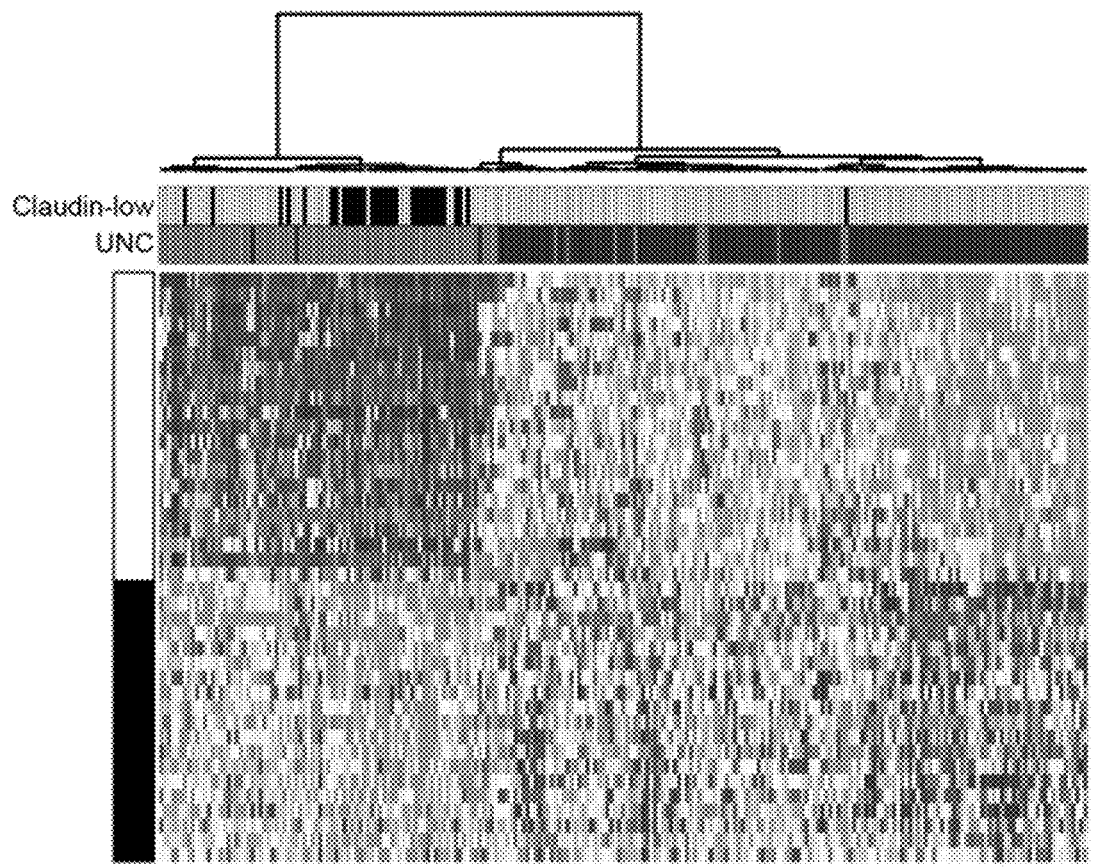
Figure 7D:
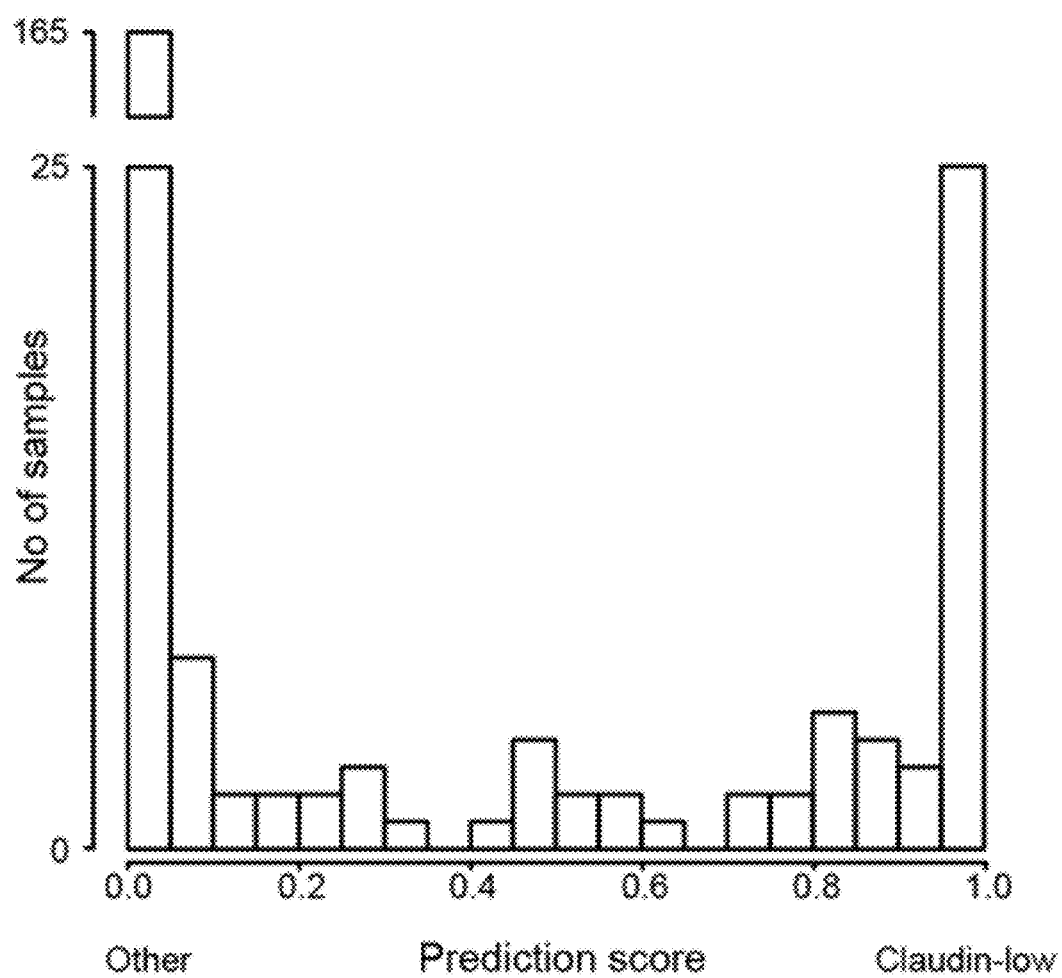
Figure 7E:
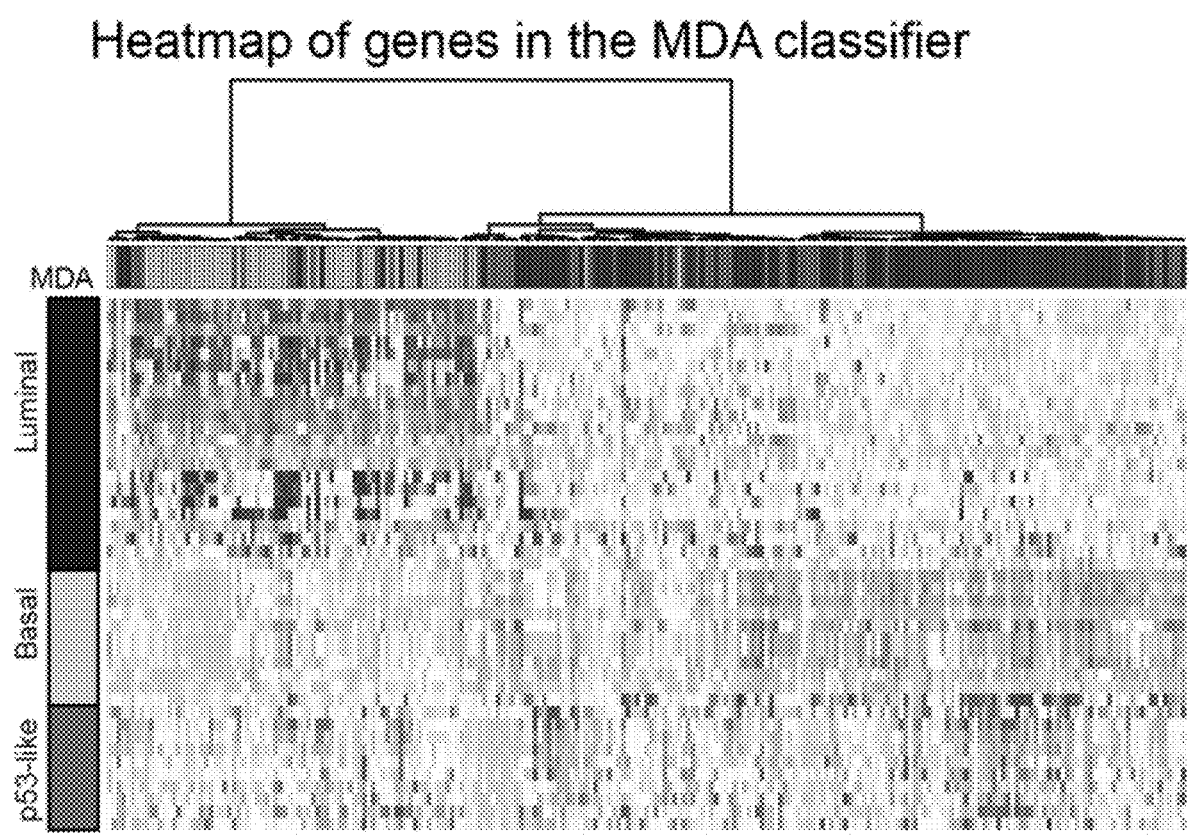
Figure 7F:
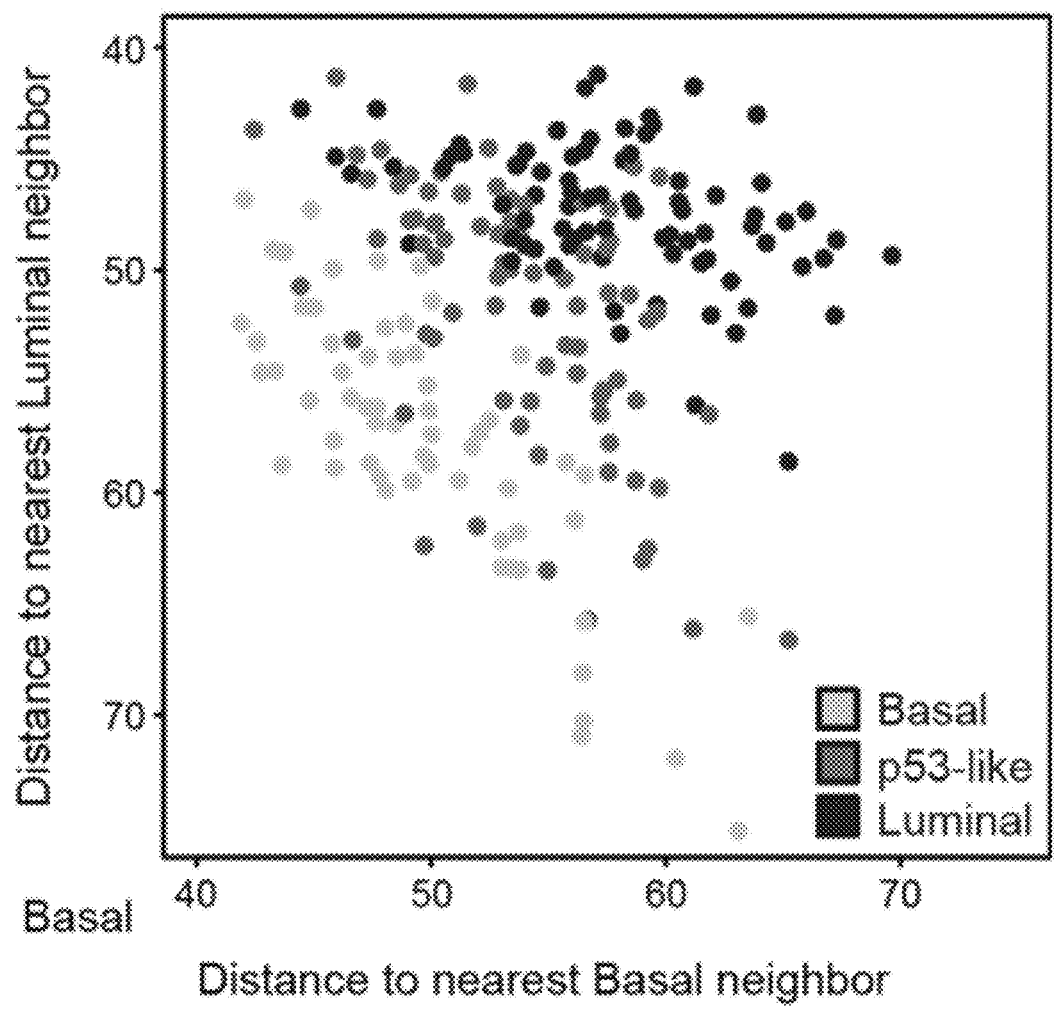

The frequency of each subtype in all pre-NAC samples (n=223) was in expected ratios (FIG. 1A). Gene expression of given biological functions confirmed the concordance between the different subtyping methods (FIG. 1B, FIG. 5 and Table 3). For example, all luminal subtypes showed a higher expression of genes for urothelial differentiation (FIGS. 1B, 7, and 10) compared to all basal subtypes. T- and myeloid cell signatures were highest in the expected subtypes (claudin-low (UNC) and cluster IV (TCGA)). Genes from the extracellular matrix (ECM) were highly expressed in p53-like (MDA, FIG. 7E) and infiltrated subtypes (Lund) (FIG. 1B).

TABLE 3

Highly Expressed Genes in Different Subtype Classes

| Gene Name | Subtype Class |
|---|---|
| UPK2 | Luminal |
| SCNN1B | Luminal |
| PPARG | Luminal |
| TOX3 | Luminal |
| GATA3 | Luminal |
| HMGCS2 | Luminal |
| RAB15 | Luminal |
| ADIRF | Luminal |
| SEMA5A | Luminal |
| TRAK1 | Luminal |
| SCNN1G | Luminal |
| TMPRSS2 | Luminal |
| VGLL1 | Luminal |
| TBX2 | Luminal |
| UPK1A | Luminal |
| GAREM | Luminal |
| BHMT | Luminal |
| SPINK1 | Luminal |
| GPD1L | Luminal |
| RNF128 | Luminal |
| CYP2J2 | Luminal |
| GDPD3 | Luminal |
| FBP1 | Luminal |
| SLC27A2 | Luminal |
| TMEM97 | Luminal |
| PLEKHG6 | Luminal |
| CYP4B1 | Luminal |
| CAPN5 | Luminal |
| SLC9A2 | Luminal |
| PPFIBP2 | Luminal |
| FAM174B | Luminal |
| KRT14 | Basal |
| DSG3 | Basal |
| KRT6B | Basal |
| KRT5 | Basal |
| KRT6A | Basal |
| KRT6C | Basal |
| PI3 | Basal |
| S100A7 | Basal |
| CD44 | Basal |
| CDH3 | Basal |
| KRT16 | Basal |
| GPX2 | Claudin |
| CACNA1D | Claudin |
| KLHDC7A | Claudin |
| CCSER1 | Claudin |
| BMP3 | Claudin |
| BCAS1 | Claudin |
| SNX31 | Claudin |
| CYP4F12 | Claudin |
| FAM3B | Claudin |
| SLC14A1 | Claudin |
| ALDH1L1 | Claudin |
| GRHL3 | Claudin |
| VSIG2 | Claudin |
| DHRS2 | Claudin |
| ACTG2 | p53 |
| CNN1 | p53 |
| MYH11 | p53 |
| MFAP4 | p53 |
| PGM5 | p53 |
| FLNC | p53 |
| ACTC1 | p53 |
| DES | p53 |
| PCP4 | p53 |
| DNM1 | p53 |
| RARRES1 | GU |

TABLE 3-continued

Highly Expressed Genes in Different Subtype Classes

| Gene Name | Subtype Class |
|---|---|
| MESP1 | GU |
| SH3GL2 | GU |
| LEAP2 | GU |
| FMO9P | GU |
| RASL11B | GU |
| CYP4F8 | GU |
| PHGDH | GU |
| SLC30A2 | GU |
| KCNG1 | GU |
| CNGA1 | GU |
| CRAT | GU |
| CDKN2A | GU |
| FAM78B | GU |
| NFIB | GU |
| ATP6V0E2 | GU |
| CRABP2 | GU |
| RASSF2 | GU |
| MCM3 | GU |
| RALBP1 | GU |
| DDAH1 | GU |
| MCM2 | GU |
| TESK2 | GU |
| EMX2 | GU |
| CCNE2 | GU |
| PTGDS | Infiltrated |
| IGLL1 | Infiltrated |
| CTSK | Infiltrated |
| SPON1 | Infiltrated |
| LUM | Infiltrated |
| HLA-DQA1 | Infiltrated |
| AEBP1 | Infiltrated |
| COL6A3 | Infiltrated |
| DCN | Infiltrated |
| SERPINE2 | Infiltrated |
| TAGLN | Infiltrated |
| HLA-DPA1 | Infiltrated |
| CDH11 | Infiltrated |
| RARRES2 | Infiltrated |
| CD48 | Infiltrated |
| ITGB2 | Infiltrated |
| CCL2 | Infiltrated |
| SRGN | Infiltrated |
| IRF8 | Infiltrated |
| COL1A2 | Infiltrated |
| TMEM119 | Infiltrated |
| RGS1 | Infiltrated |
| TYROBP | Infiltrated |
| PLEK | Infiltrated |
| FCN1 | Infiltrated |
| PODN | Infiltrated |
| C1QB | Infiltrated |
| PDLIM3 | Infiltrated |
| COL3A1 | Infiltrated |
| WAS | Infiltrated |
| MS4A6A | Infiltrated |
| ALOX5AP | Infiltrated |
| CSF1R | Infiltrated |
| DOCK2 | Infiltrated |
| COL8A1 | Infiltrated |
| LY96 | Infiltrated |
| RGS2 | Infiltrated |
| HLA-DRA | Infiltrated |
| ACTA2 | Infiltrated |

Similarities between Subtypes across Different Methods

Figure 1F:
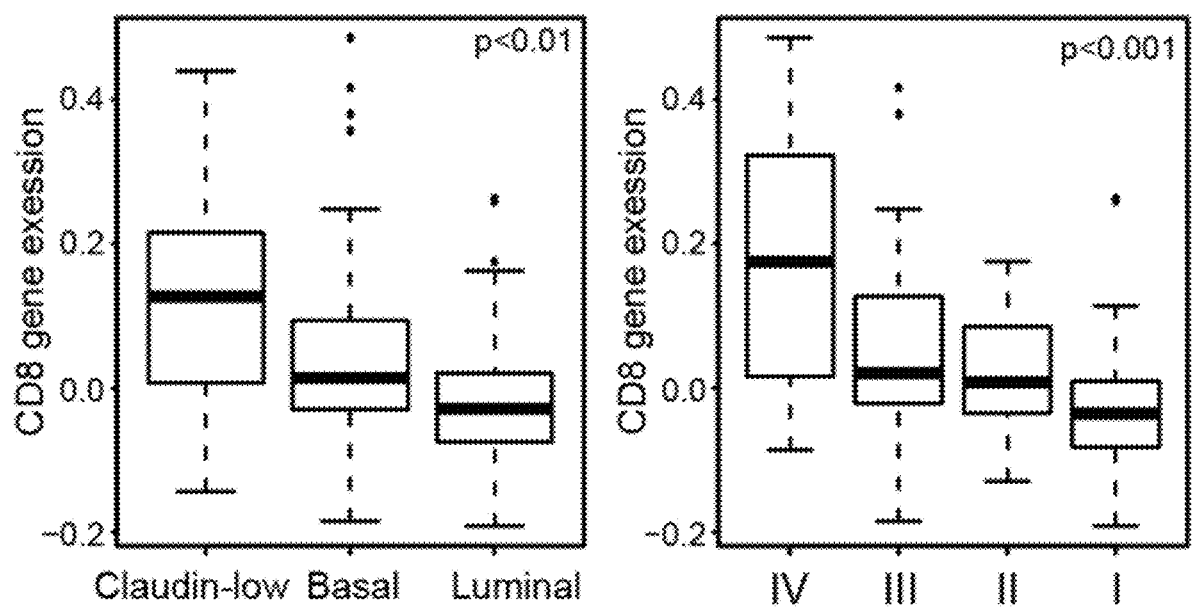
Figure 2A:
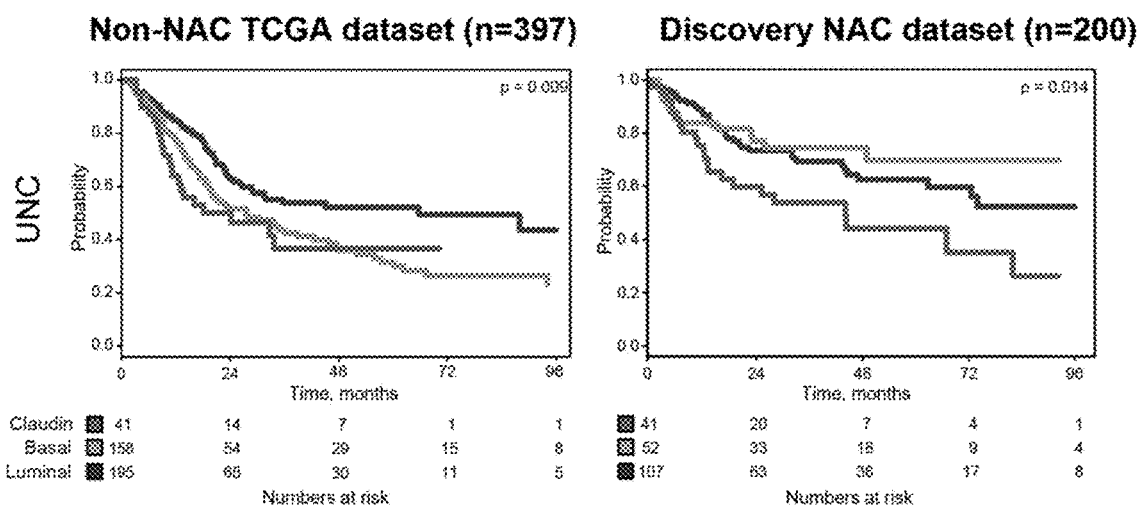
FIGS. 2A-2D show Kaplan Meier estimates of overall survival (OS) according to molecular subtype in the non-NAC (left) and NAC (right) discovery datasets.
Figure 2B:
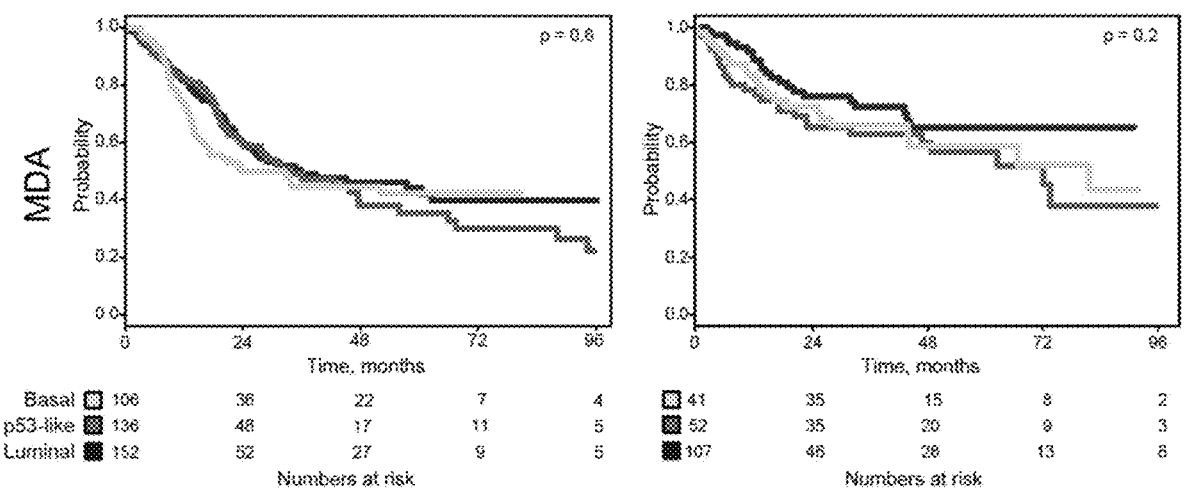
Figure 2C:
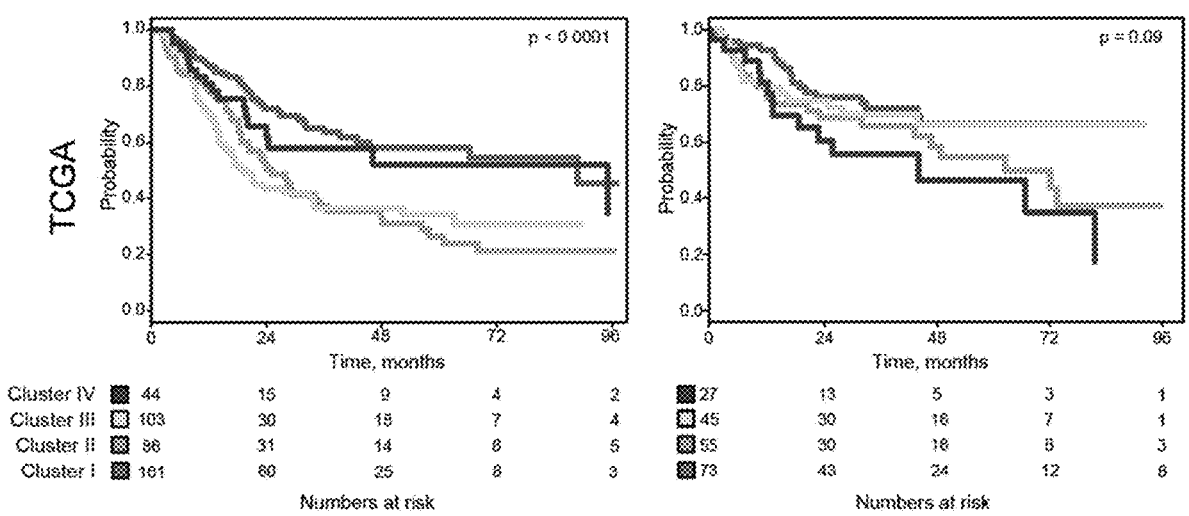
Figure 2D:
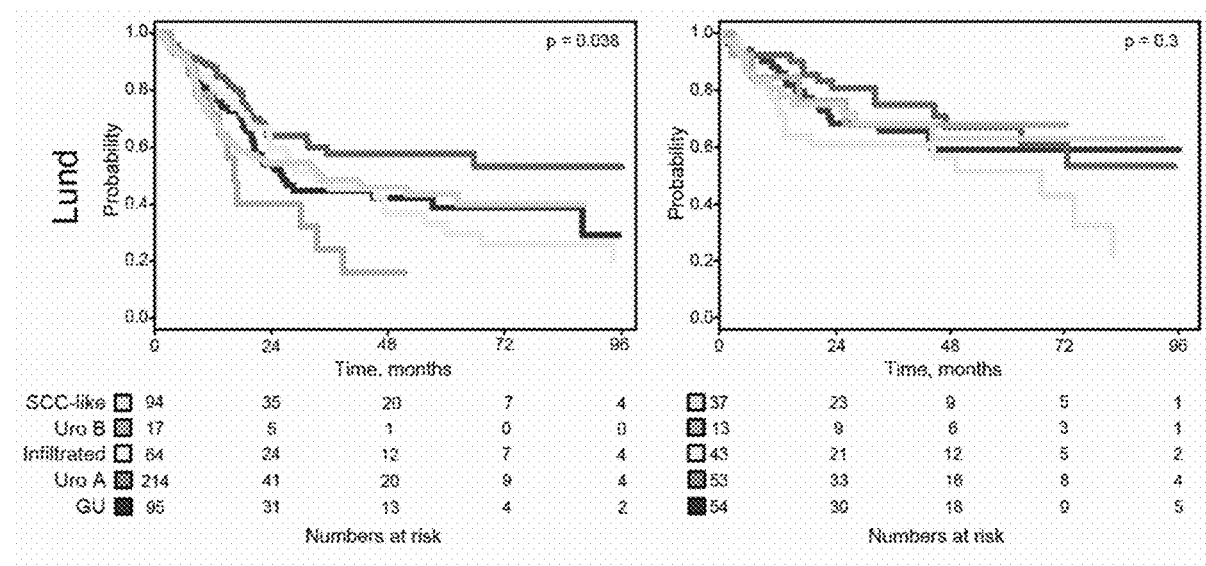
Figure 8A:
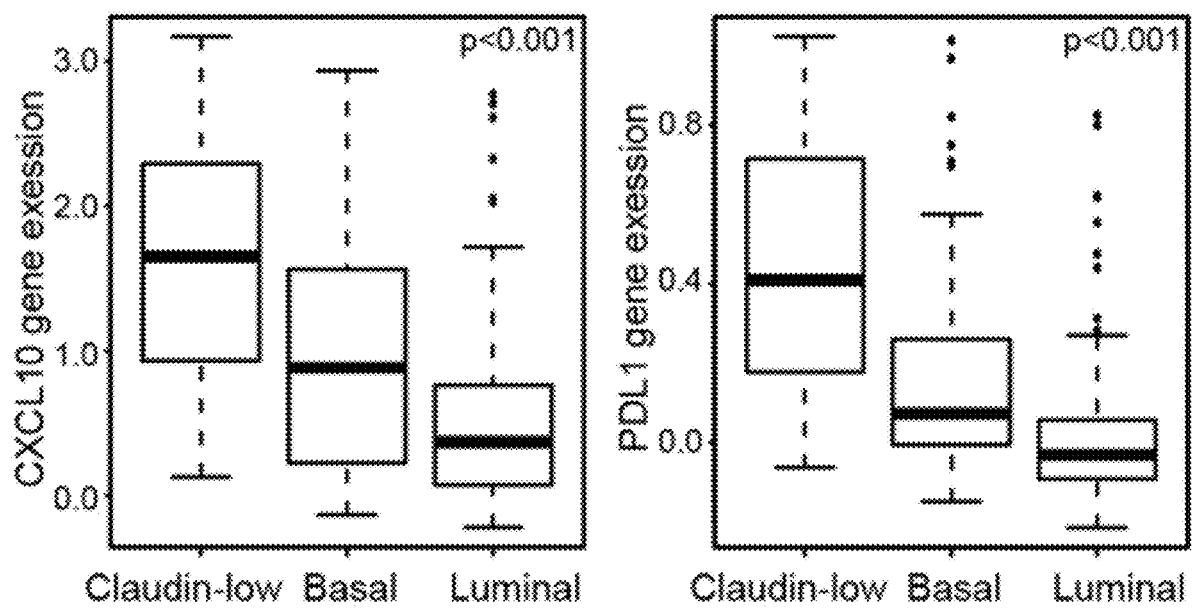
FIGS. 8A-8E show an analysis of immune infiltration and markers of epithelial-to-mesenchymal transition (EMT) in pre-NAC tumors classified according to the UNC and TCGA classifiers.
Figure 8B:
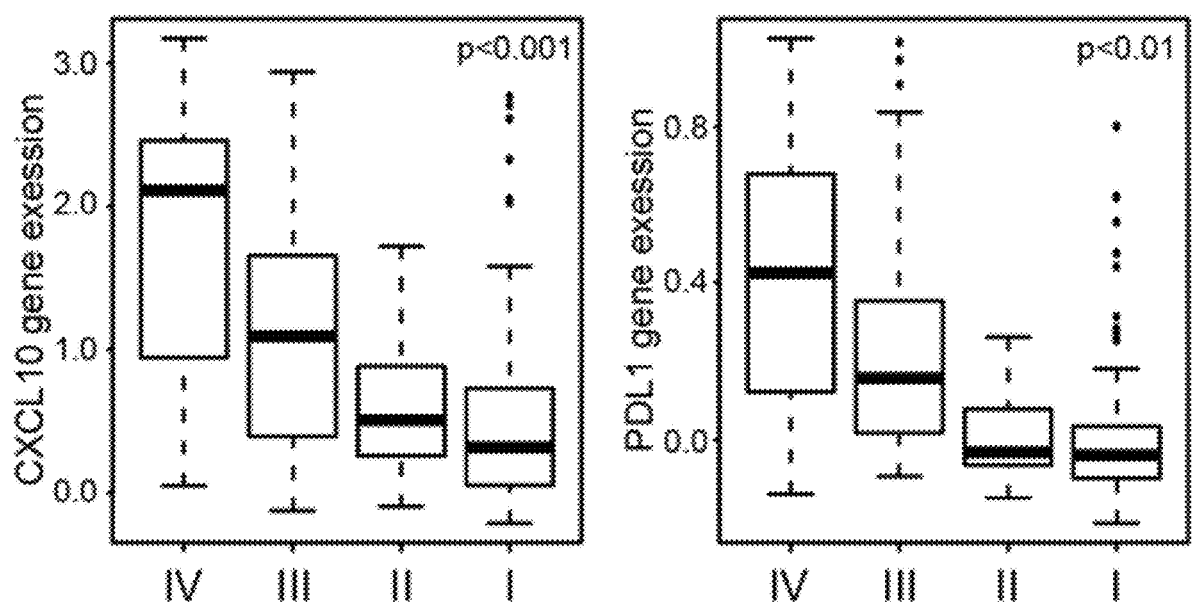
Figure 8C:
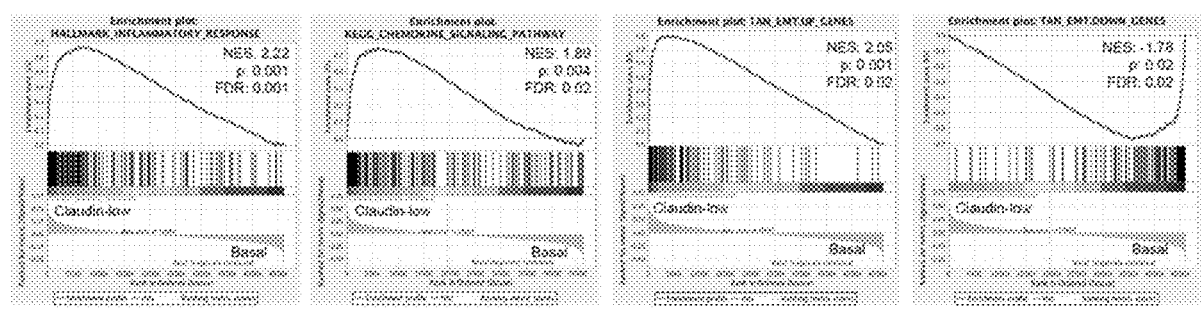
Figure 8D:
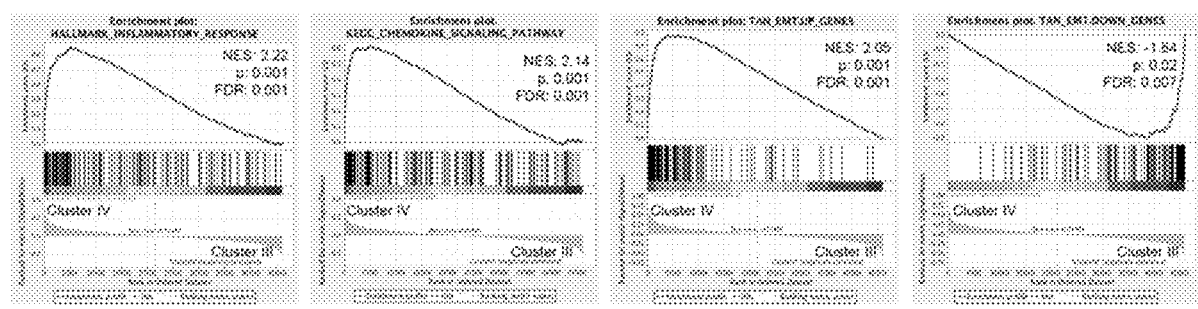
Figure 8E:
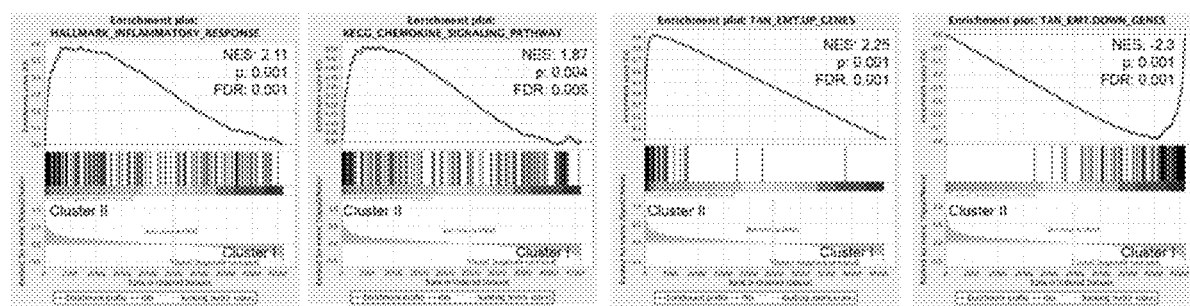
Figure 9A:
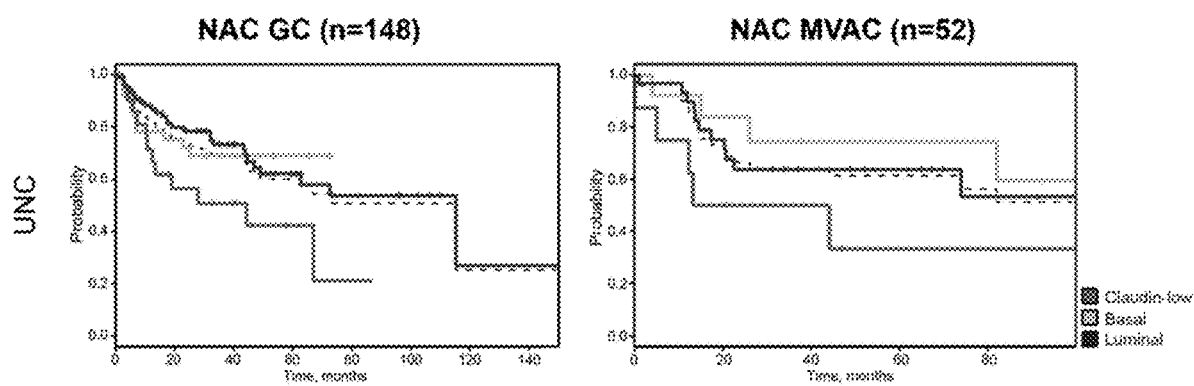
FIGS. 9A-9D show the overall survival (OS) analysis of the NAC cohort according to chemotherapy regimen stratified by subtype: gemcitabine/cisplatin (GC, left) and methotrexate, vinblastine, adriamycin and cisplatin (MVAC, right).
Figure 9B:
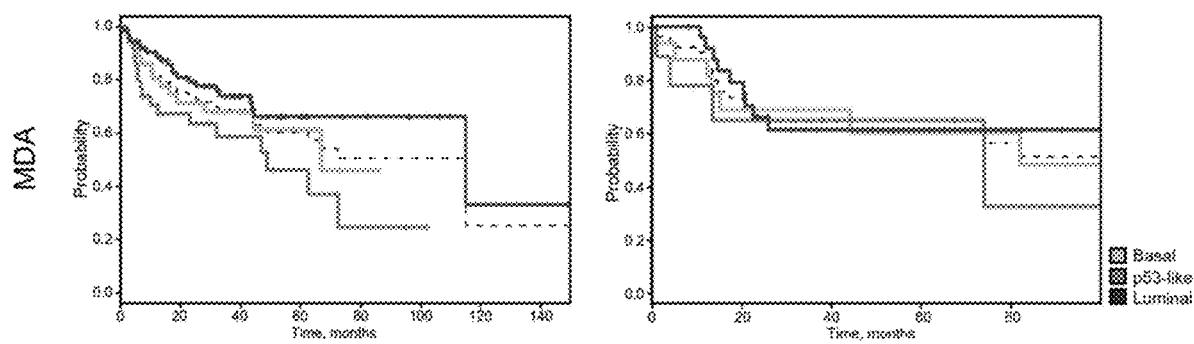
Figure 9C:
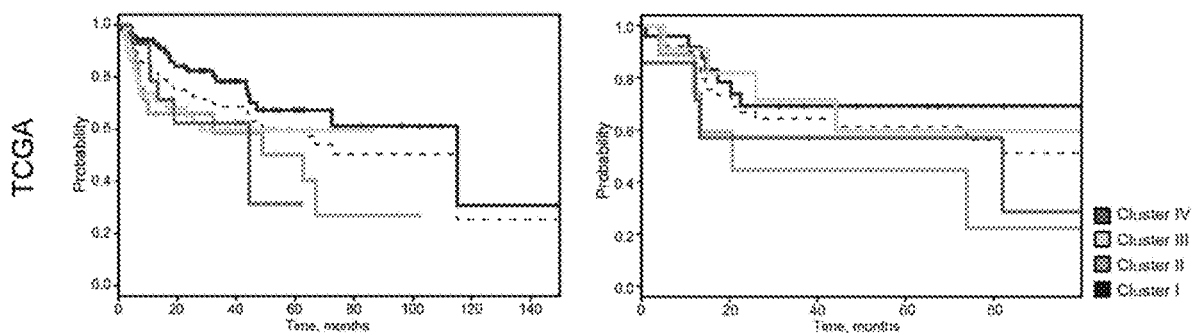
Figure 9D:
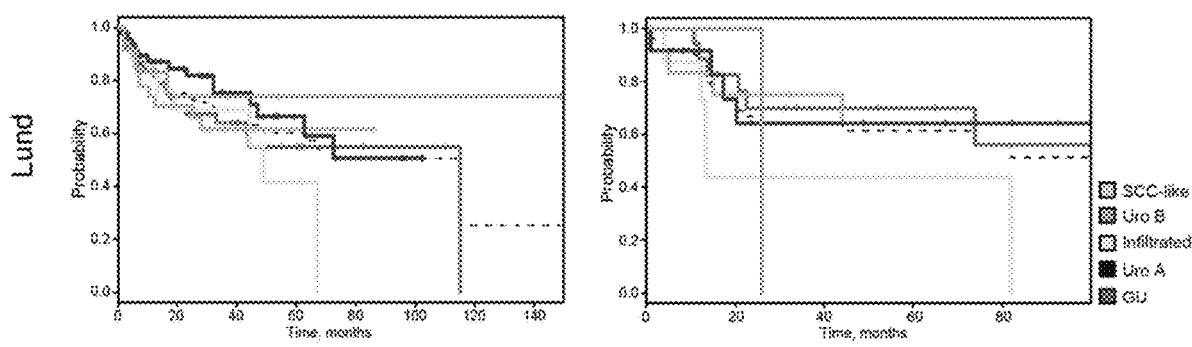

Claudin-low tumors have basal characteristics with high expression levels of genes indicative of epithelial-to-mesenchymal transition (EMT) and immune infiltration (FIGS. 1C-1E and FIGS. 8A and 8C). Tumors in TCGA cluster IV identify a similar subset of basal tumors: 21/28 cluster IV tumors were labeled claudin-low. Cluster IV showed enrichment for EMT, chemokine signaling and immune infiltration compared to cluster III tumors (FIGS. 1C, 1D, 1F, 8B, and 8D). Cluster II represents luminal tumors that are immune infiltrated. Compared to cluster I tumors, cluster II tumors were EMT-signature positive and enriched for inflammatory response and chemokine signaling (FIGS. 1F, 8B, and 8E).

Patient Benefit from NAC Differs between Subtypes

Extravesical extension of residual primary tumor (pT3/4) after NAC was observed more frequently in claudin-low (49%), p53-like (39%), and cluster II (40%) subtypes. None of the subtypes was associated with major response to NAC (ypT<2N0) on final pathology (Table 4).

TABLE 4

Subtypes, Pathological Tumor Stage, and Lymph Node Status

| Subtypes | Variables | Total n (%) | Pathologic Tumor Stage (n (%)) | | | | Lymph Node Status (n (%)) | | <pT2N0 (%) | |
|---|---|---|---|---|---|---|---|---|---|---|
| | | | pT0/is/a | pT1 | pT2 | pT3/4 | 0 | 1 | 0 | 1 |
| UNC (%) | Luminal | 197 (49.6) | 1 (0.6) | 2 (1.1) | 73 (41.0) | 102 (57.3) | 120 (60.9) | 77 (39.1) | 88 (97.8) | 2 (2.2) |
| | Basal | 159 (40.1) | 0 (0.0) | 1 (0.7) | 36 (24.5) | 110 (74.8) | 91 (57.2) | 68 (42.8) | 62 (100.0) | 0 (0.0) |
| | Claudin | 41 (10.3) | 0 (0.0) | 0 (0.0) | 7 (17.5) | 33 (82.5) | 27 (65.9) | 14 (34.1) | 16 (100.0) | 0 (0.0) |
| MDA (%) | Luminal | 153 (38.5) | 1 (0.7) | 1 (0.7) | 50 (37.3) | 82 (61.2) | 87 (56.9) | 66 (43.1) | 62 (98.4) | 1 (1.6) |
| | p53 | 137 (34.5) | 0 (0.0) | 1 (0.8) | 41 (31.5) | 88 (67.7) | 79 (57.7) | 58 (42.3) | 63 (98.4) | 1 (1.6) |
| | Basal | 107 (27.0) | 0 (0.0) | 1 (1.0) | 25 (24.8) | 75 (74.3) | 72 (67.3) | 35 (32.7) | 41 (100.0) | 0 (0.0) |
| TCGA (%) | Cluster I | 163 (41.1) | 1 (0.7) | 2 (1.4) | 72 (49.7) | 70 (48.3) | 114 (69.9) | 49 (30.1) | 76 (97.4) | 2 (2.6) |
| | Cluster II | 86 (21.7) | 0 (0.0) | 0 (0.0) | 12 (14.5) | 71 (85.5) | 29 (33.7) | 57 (66.3) | 34 (100.0) | 0 (0.0) |
| | Cluster III | 103 (25.9) | 0 (0.0) | 0 (0.0) | 22 (23.4) | 72 (76.6) | 66 (64.1) | 37 (35.9) | 34 (100.0) | 0 (0.0) |
| | Cluster IV | 45 (11.3) | 0 (0.0) | 1 (2.3) | 10 (23.3) | 32 (74.4) | 29 (64.4) | 16 (35.6) | 22 (100.0) | 0 (0.0) |
| Lund (%) | GU | 96 (24.2) | 1 (1.1) | 1 (1.1) | 27 (30.3) | 60 (67.4) | 46 (47.9) | 50 (52.1) | 41 (97.6) | 1 (2.4) |
| | Uro | 125 (31.5) | 0 (0.0) | 1 (0.9) | 49 (44.1) | 61 (55.0) | 84 (67.2) | 41 (32.8) | 54 (98.2) | 1 (1.8) |
| | Infiltrated | 65 (16.4) | 0 (0.0) | 0 (0.0) | 9 (14.3) | 54 (85.7) | 39 (60.0) | 26 (40.0) | 29 (100.0) | 0 (0.0) |
| | Uro B | 17 (4.3) | 0 (0.0) | 0 (0.0) | 3 (18.8) | 13 (81.2) | 10 (58.8) | 7 (41.2) | 5 (100.0) | 0 (0.0) |
| | SCC-like | 94 (23.7) | 0 (0.0) | 1 (1.2) | 28 (32.6) | 57 (66.3) | 59 (62.8) | 35 (37.2) | 37 (100.0) | 0 (0.0) |

NAC Cisplatin based (n = 200)

| Subtypes | Variables | Total n (%) | Pathologic Tumor Stage (n (%)) | | | | Lymph Node Status (n (%)) | | Major response (%) | |
|---|---|---|---|---|---|---|---|---|---|---|
| | | | pT0/is/a | pT1 | pT2 | pT3/4 | 0 | 1 | 0 | 1 |
| UNC (%) | Luminal | 107 (53.5) | 44 (41.5) | 8 (7.5) | 26 (24.5) | 28 (26.4) | 72 (72.7) | 27 (27.3) | 57 (57.6) | 42 (42.4) |
| | Basal | 52 (26.0) | 22 (42.3) | 3 (5.8) | 10 (19.2) | 17 (32.7) | 43 (84.3) | 8 (15.7) | 30 (58.8) | 21 (41.2) |
| | Claudin | 41 (20.5) | 17 (41.5) | 1 (2.4) | 3 (7.3) | 20 (48.8) | 29 (72.5) | 11 (27.5) | 23 (57.5) | 17 (42.5) |
| MDA (%) | Luminal | 78 (39.0) | 29 (37.7) | 5 (6.5) | 22 (28.6) | 21 (27.3) | 50 (69.4) | 22 (30.6) | 45 (62.5) | 27 (37.5) |
| | p53 | 66 (33.0) | 26 (39.4) | 4 (6.1) | 11 (16.7) | 25 (37.9) | 49 (77.8) | 14 (22.2) | 40 (63.5) | 23 (36.5) |
| | Basal | 56 (28.0) | 28 (50.0) | 3 (5.4) | 6 (10.7) | 19 (33.9) | 45 (81.8) | 10 (18.2) | 25 (45.5) | 30 (54.5) |
| TCGA (%) | Cluster I | 73 (36.5) | 30 (41.7) | 6 (8.3) | 21 (29.2) | 15 (20.8) | 50 (74.6) | 17 (25.4) | 38 (56.7) | 29 (43.3) |
| | Cluster II | 55 (27.5) | 22 (40.0) | 3 (5.5) | 8 (14.5) | 22 (40.0) | 36 (69.2) | 16 (30.8) | 34 (65.4) | 18 (34.6) |
| | Cluster III | 45 (22.5) | 19 (42.2) | 1 (2.2) | 8 (17.8) | 17 (37.8) | 38 (84.4) | 7 (15.6) | 26 (57.8) | 19 (42.2) |
| | Cluster IV | 27 (13.5) | 12 (44.4) | 2 (7.4) | 2 (7.4) | 11 (40.7) | 20 (76.9) | 6 (23.1) | 12 (46.2) | 14 (53.8) |

TABLE 4-continued

Subtypes, Pathological Tumor Stage, and Lymph Node Status

| | | | | | | | | | |
|---|---|---|---|---|---|---|---|---|---|
| Lund (%) | GU | 54 | 23 | 1 | 11 | 19 | 35 | 16 | 32 | 19 |
| | | (27.0) | (42.6) | (1.9) | (20.4) | (35.2) | (68.6) | (31.4) | (62.7) | (37.3) |
| | Uro | 53 | 22 | 5 | 14 | 11 | 39 | 10 | 27 | 22 |
| | | (26.5) | (42.3) | (9.6) | (26.9) | (21.2) | (79.6) | (20.4) | (55.1) | (44.9) |
| | Infiltrated | 43 | 18 | 4 | 4 | 17 | 29 | 11 | 21 | 19 |
| | | (21.5) | (41.9) | (9.3) | (9.3) | (39.5) | (72.5) | (27.5) | (52.5) | (47.5) |
| | Uro B | 13 | 4 | 2 | 3 | 4 | 11 | 2 | 8 | 5 |
| | | (6.5) | (30.8) | (15.4) | (23.1) | (30.8) | (84.6) | (15.4) | (61.5) | (38.5) |
| | SCC-like | 37 | 16 | 0 | 7 | 14 | 30 | 7 | 22 | 15 |
| | | (18.5) | (43.2) | (0.0) | (18.9) | (37.8) | (81.1) | (18.9) | (59.5) | (40.5) |

*Pathologic tumor stage and lymph node status are unavailable in the MDA and Lund sets Overall survival varied by molecular subtype and between non-NAC and NAC patients (FIG. 2). By all subtyping methods, non-NAC treated patients (TCGA cohort) with basal tumors had worse outcomes compared to luminal tumors (FIG. 2). Of both luminal TCGA clusters, patients with cluster II tumors experienced worse OS than those with cluster I tumors. Poor OS was also observed in patients with claudin-low tumors. The association between subtype and prognosis differed in our NAC cohort. The most pronounced difference was in patients with basal or equivalent subtypes (Cluster III, UroB, and SCC-like), who experienced an improvement in OS after NAC compared to the TCGA patients who received no NAC (FIG. 2). However, there was no such shift in survival in patients with claudin-low and cluster IV tumors, indicating that these patients fared poorly regardless of NAC even though they are subsets of the basal phenotype. Across the different subtyping methods, patients with luminal or equivalent tumors had the best OS with or without NAC, with the exception of cluster II patients, who fared poorly in both settings, as did patients with p53-like tumors. There was no noteworthy difference in these trends when the patients were analyzed according to NAC regimen (GC vs. MVAC; FIG. 9).

In summary, the differences in OS by subtype and the apparent impact of NAC suggest that a classification into four subtypes would have the greatest clinical relevance. Basal tumors warrant subclassification into tumors without and with EMT and immune infiltration (i.e., basal and claudin-low), since NAC has the greatest impact on the non-infiltrated basal tumors. Luminal tumors similarly warrant subclassification into tumors without and with EMT and immune infiltration (i.e., luminal and luminal-infiltrated), since OS differs between the two groups.

Single Sample Classifier to Predict Bladder Cancer Subtypes

Figure 3A:
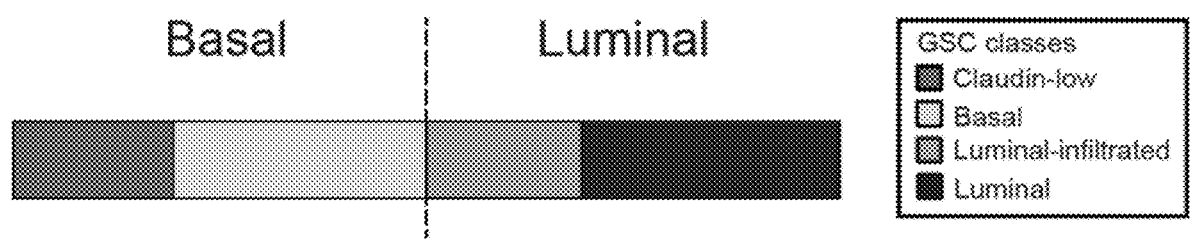
FIGS. 3A-3C show discovery and validation of the genomic subtyping classifier (GSC).
Figure 3B:
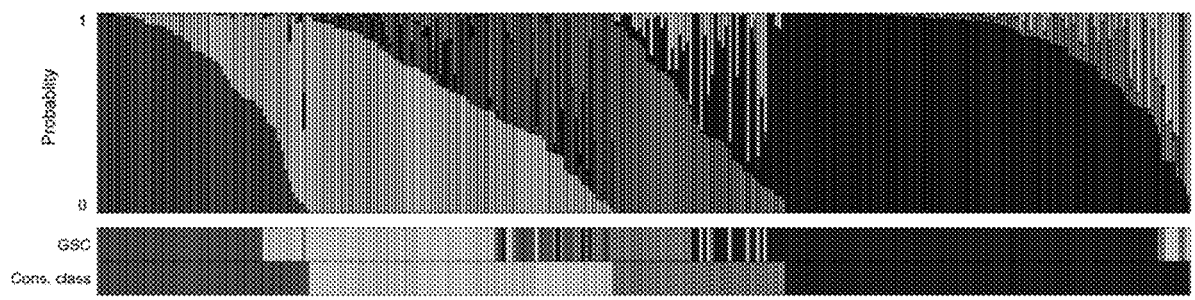
Figure 3C:
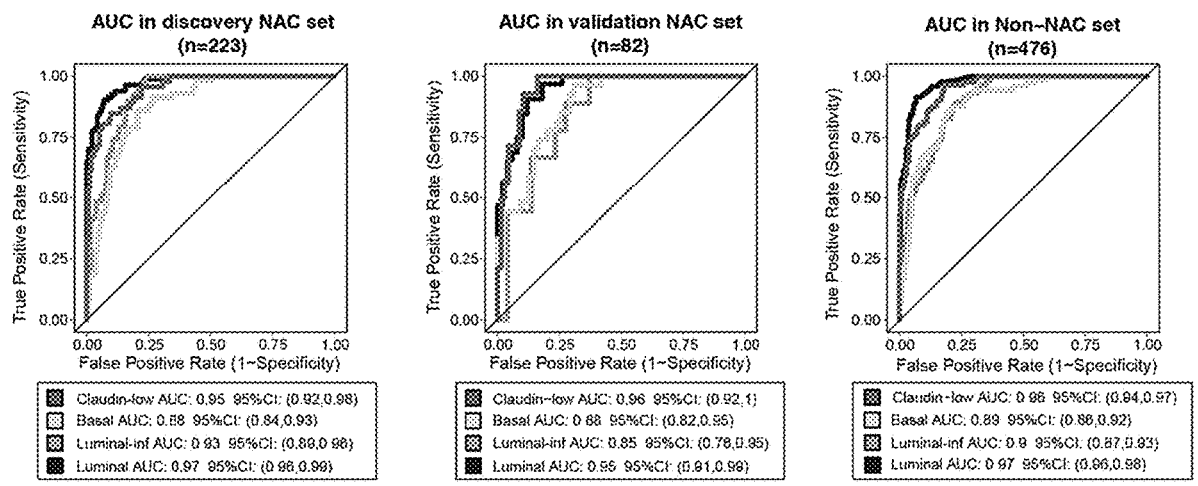
Figure 10:
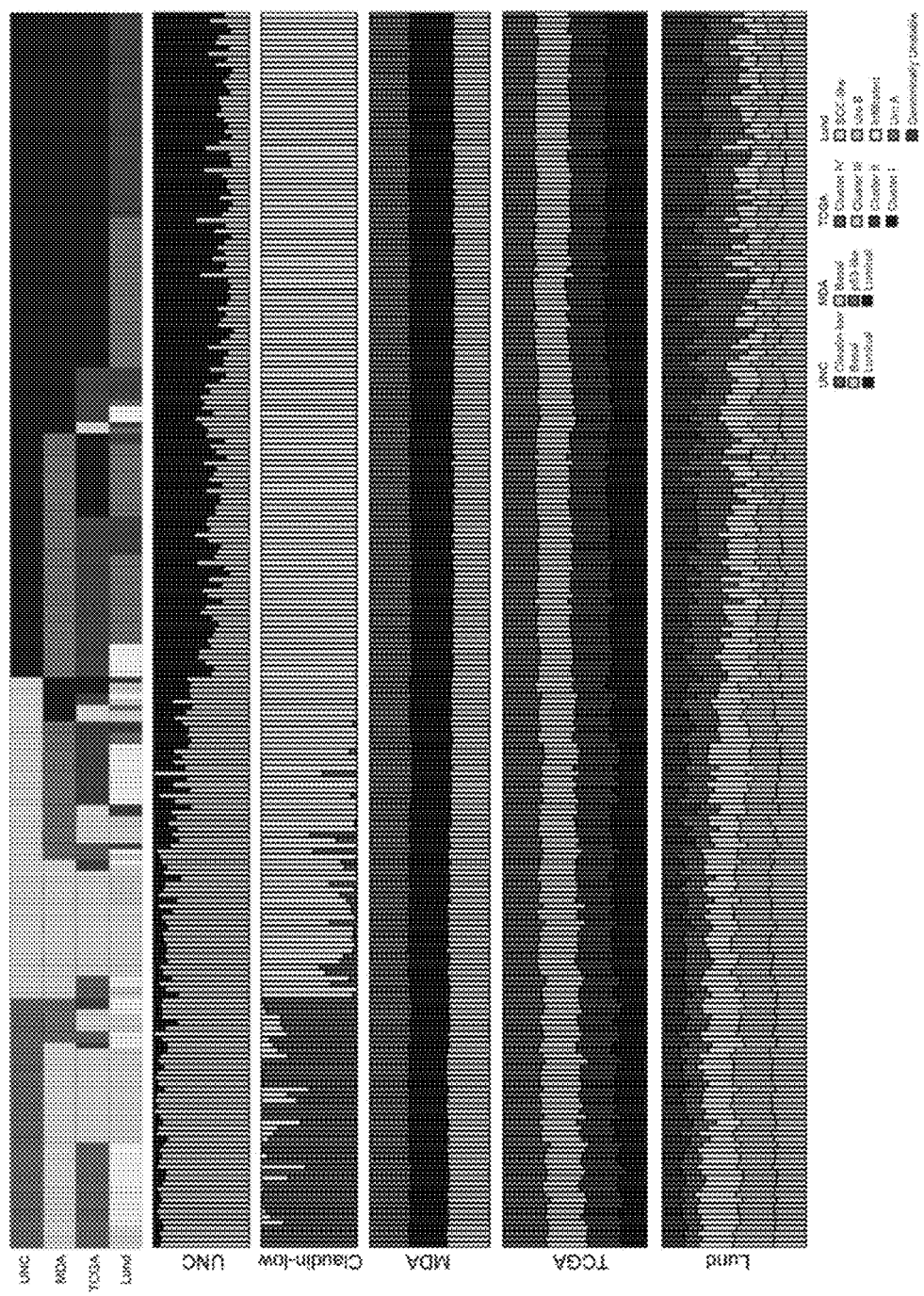
FIG. 10 shows the probability of subtype calls. This diagram shows across the top the subtype calls in the 223 TURBT samples of the discovery NAC dataset according to all subtyping methods. The probability of a tumor being assigned to each subtype within a given subtyping model is shown in the stacked barplot below.

Based on the biological characteristics and different impact on clinical outcome we trained a single sample genomic subtyping classifier (GSC) to predict 4 classes based on the consensus of the different classification schemes: claudin-low, basal, luminal-infiltrated and luminal (FIG. 3A and Table 5). Compared to previously published methods, the single sample GSC was more discriminate in assigning individual patients to a definitive subtype as seen by the number of patients that have a dominant subtype score (FIG. 3B and FIG. 10). The 10-fold cross-validation accuracy of GSC using the discovery cohort (n=223) was 83%. In the validation cohort (n=82), the accuracy was 73%. When we assign the subtype based on majority class the accuracy is 39% (p<0.001), which indicates that GSC is performing better than no-information rate. In both the NAC and non-NAC cohort (n=476), consensus subtype classes (i.e., those obtained using previously published clustering-based approaches) were all predicted with areas under the curve >0.85 (FIG. 3C).

TABLE 5

GSC Model

| GeneName/Intercept | Claudin-low | Basal | Luminal | Luminal-infiltrated |
|---|---|---|---|---|
| Intercept | -2.7422243 | 0.6042435 | 0.4472407 | 1.69074 |
| TMEM45B | -0.76380459 | . | . | . |
| ERBB2 | -0.41274889 | . | 0.150363923 | . |
| TNFRSF21 | -0.29642837 | . | . | 0.01953379 |
| FLRT3 | -0.29503283 | . | . | . |
| SPINK1 | -0.27540335 | . | . | . |
| LRRC37A2 | -0.27534664 | . | . | 0.31619037 |
| SCCPDH | -0.26879963 | . | . | . |
| UGT1A3 | -0.25832055 | . | . | . |
| ZNF486 | -0.25688633 | . | . | 0.2026522 |
| UGT1A8 | -0.24432959 | . | . | . |
| PPARG | -0.23354307 | . | . | . |
| UGT1A1 | -0.17875953 | . | . | . |
| AHR | -0.16157731 | . | . | . |
| EPCAM | -0.1575933 | . | . | . |
| PVRL4 | -0.15542842 | . | . | . |
| UGT1A4 | -0.15152295 | . | . | . |
| IGFBP3 | -0.12297767 | 2.17E-03 | . | . |
| S100P | -0.12075992 | . | . | . |
| PTPRM | -0.11969204 | . | . | . |
| NQO1 | -0.11797201 | . | . | . |
| RNF138P1 | -0.11438041 | . | . | . |
| CPSF6 | -0.10415486 | 7.95E-02 | 0.399489016 | -0.37481247 |
| GATA3 | -0.09830126 | . | . | . |
| UGT1A5 | -0.06289802 | . | . | . |
| UGT1A10 | -0.0614663 | . | . | . |
| ELF3 | -0.05358228 | . | . | . |
| AGR2 | -0.04732648 | . | . | . |
| EHF | -0.04346927 | . | 0.06822185 | . |
| SLC14A1 | -0.02475621 | . | . | . |
| CXCL17 | -0.01411846 | . | . | . |
| TMSB10 | 0.03420844 | . | . | -0.53821096 |
| CCL5 | 0.03720007 | . | . | . |
| MMP12 | 0.03846914 | . | . | . |
| SAT1 | 0.04934262 | . | . | . |
| CD68 | 0.06295573 | . | . | . |
| ANXA1 | 0.06652168 | . | . | . |
| IFITM2 | 0.08147351 | . | -0.241921432 | . |
| KRT5 | 0.09479006 | . | . | . |
| GJB2 | 0.09816201 | . | . | -0.33181587 |
| MT1L | 0.09851147 | . | . | . |
| NDRG1 | 0.10341095 | . | . | . |
| ASPN | 0.1211993 | . | . | . |
| SULF1 | 0.12310402 | -2.12E-02 | . | . |
| EFEMP1 | 0.12921654 | 1.82E-02 | -0.26599067 | . |
| G0S2 | 0.14303768 | . | . | . |
| TIMP3 | 0.1494699 | . | . | . |
| MUC16 | 0.16194856 | . | . | . |
| GBP1 | 0.18838626 | . | . | . |
| CGB2 | 0.19502279 | . | . | . |
| SNAI2 | 0.26861569 | . | . | . |
| DDIT4 | 0.29468037 | . | . | -0.0253577 |

TABLE 5-continued

GSC Model

| GeneName/Intercept | Claudin-low | Basal | Luminal | Luminal-infiltrated |
|---|---|---|---|---|
| CTSK | 0.31500848 | . | . | . |
| GBP5 | 0.33917204 | . | . | . |
| C3 | 0.34198121 | . | . | . |
| VIM | 0.34247125 | . | −0.333388459 | . |
| BGN | 0.38325778 | . | . | . |
| TGFBI | 0.41441125 | . | . | . |
| TIMP2 | 0.49419418 | . | −0.747524226 | . |
| SAA1 | 0.50978549 | −1.57E−01 | . | . |
| LAMC2 | 1.07099112 | . | . | . |
| FBP1 | . | −4.94E−01 | . | . |
| BAMBI | . | −4.65E−01 | . | 0.62521761 |
| PAQR7 | . | −4.28E−01 | . | 0.17060714 |
| IGFL1 | . | −3.99E−01 | . | . |
| TMPRSS2 | . | −3.47E−01 | . | 0.01052618 |
| PLXNB2 | . | −2.47E−01 | 0.118514328 | . |
| MAL | . | −2.11E−01 | . | . |
| TBX3 | . | −2.10E−01 | . | . |
| CRISP3 | . | −2.10E−01 | . | . |
| SCNN1B | . | −1.27E−01 | 0.062367003 | . |
| RNF128 | . | −1.08E−01 | . | . |
| KRT7 | . | −1.06E−01 | . | 0.21623783 |
| KRT8 | . | −1.04E−01 | 0.054120532 | . |
| ADAM10 | . | −1.01E−01 | . | . |
| SNX31 | . | −8.45E−02 | . | . |
| KRT18 | . | −6.26E−02 | . | . |
| UPK3A | . | −5.34E−02 | . | 0.14925342 |
| PSCA | . | −5.21E−02 | . | 0.08135977 |
| UPK2 | . | −4.67E−02 | . | . |
| AHNAK | . | −4.14E−02 | . | . |
| SPP1 | . | −1.45E−05 | . | . |
| TWIST2 | . | 5.93E−03 | . | −0.23104866 |
| SPARCL1 | . | 3.73E−02 | . | . |
| CASP14 | . | 4.48E−02 | . | −0.11998154 |
| MMP1 | . | 6.30E−02 | . | −0.19359346 |
| LAPTM5 | . | 6.63E−02 | −0.177011814 | . |
| MMP13 | . | 1.07E−01 | −0.069693132 | . |
| DUSP1 | . | 1.21E−01 | . | . |
| HIST1H2BF | . | 1.43E−01 | . | −0.25591353 |
| GABRP | . | 1.50E−01 | −0.070690688 | . |
| CFH | . | 1.60E−01 | . | . |
| SFRP2 | . | 1.82E−01 | . | . |
| SERPINB3 | . | 2.20E−01 | . | . |
| MGP | . | 2.45E−01 | . | . |
| FGFBP1 | . | 2.78E−01 | . | . |
| SAMD9 | . | 3.06E−01 | . | −0.06285417 |
| ITGA6 | . | 3.25E−01 | . | −0.09370337 |
| MALL | . | 3.31E−01 | . | . |
| MYL9 | . | . | −0.999232474 | . |
| IER3 | . | . | −0.687801478 | . |
| SPRR2F | . | . | −0.61048673 | . |
| MMP2 | . | . | −0.399399819 | . |
| HLA-DRA | . | . | −0.38019527 | . |
| DCN | . | . | −0.375988905 | . |
| TPM2 | . | . | −0.345807041 | . |
| HLA-A | . | . | −0.281158422 | 0.03357846 |
| LYZ | . | . | −0.187899622 | . |
| LUM | . | . | −0.157376466 | . |
| COL3A1 | . | . | −0.153285156 | . |
| POSTN | . | . | −0.141374249 | . |
| IFI30 | . | . | −0.133083286 | . |
| CD74 | . | . | −0.13175311 | . |
| VCAN | . | . | −0.091561626 | . |
| CALD1 | . | . | −0.091095352 | . |
| COL1A2 | . | . | −0.067763793 | . |
| HLA-DRB5 | . | . | −0.065668114 | . |
| OLFM4 | . | . | −0.05716249 | 0.06578151 |
| THBS2 | . | . | −0.04634627 | . |
| KRT23 | . | . | −0.044256964 | 0.46448906 |
| MYH11 | . | . | −0.017696254 | . |
| CLDN1 | . | . | −0.006052002 | . |
| RARRES1 | . | . | 0.023359372 | . |
| HPGD | . | . | 0.027477018 | . |
| ACER2 | . | . | 0.047288785 | . |
| RALBP1 | . | . | 0.052375622 | . |
| GSTM3 | . | . | 0.055776901 | . |
| BTBD16 | . | . | 0.100666013 | . |
| MACC1 | . | . | 0.103125969 | . |
| SEMA5A | . | . | 0.191690977 | . |
| ACOX1 | . | . | 0.204716367 | . |
| GSTM2 | . | . | 0.222507094 | −0.08536794 |
| CYP4Z2P | . | . | 0.229906712 | . |
| ZNF91 | . | . | 0.279026734 | . |
| STS | . | . | 0.288073414 | . |
| TOX3 | . | . | 0.292642628 | . |
| PLP2 | . | . | 0.555630814 | −0.17248888 |
| TACSTD2 | . | . | 0.711732783 | . |
| ATP8B1 | . | . | 0.888026967 | . |
| GRHL3 | . | . | 0.997892673 | . |
| TNC | . | . | . | −0.17479452 |
| TPX2 | . | . | . | −0.16128164 |
| DSP | . | . | . | −0.11656081 |
| TIMP1 | . | . | . | −0.11239522 |
| UPK1B | . | . | . | 0.02463108 |
| DHRS2 | . | . | . | 0.0442373 |
| PTN | . | . | . | 0.08733354 |
| SNCG | . | . | . | 0.13583842 |
| ACTG2 | . | . | . | 0.2287977 |
| SYTL2 | . | . | . | 0.31278763 |

Prediction of Clinical Endpoints Using GSC

Figure 4A:
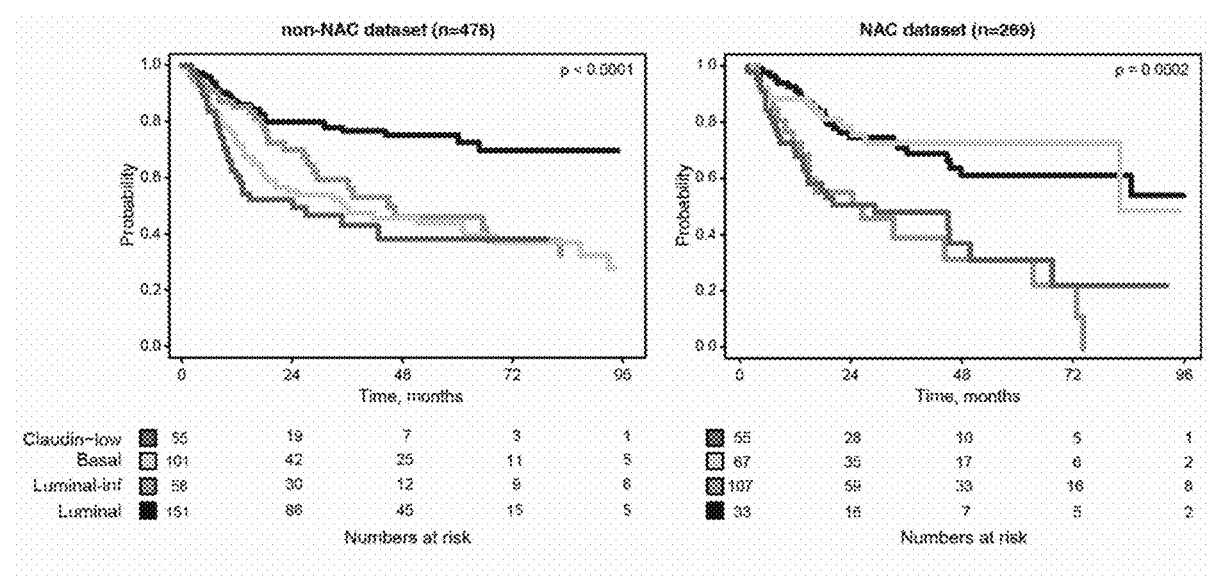
FIGS. 4A-4C show the clinical significance of GSC with and without cisplatin based NAC.

In both NAC datasets, we only used cases that were treated with cisplatin-based NAC for this analysis. The clinical significance of the predicted classes in the NAC datasets was compared with an independent non-NAC dataset that combined patients from TCGA, MD Anderson Cancer Center and the University of Lund datasets (n=476). We validated the relative changes in outcome by GSC subtype in patients treated with and without NAC (FIG. 4A). Patients with GSC basal tumors had a 3-year OS rate of 49.2% (95% confidence interval (CI) 39.5-61.2%; p<0.001) in the non-NAC cohort compared to 77.8% (95% CI 67.2-90.0%; p<0.001) in the NAC cohort.

In multivariable analysis adjusting for clinical tumor stage, age and gender in the non-NAC cohort, patients with a GSC basal subtype had a hazard ratio of 2.22 (p=0.002; Table 6) for OS compared to the luminal subtype. In the NAC cohort, GSC basal subtype patients did not fare differently than patients with luminal tumors (HR: 0.84, p=0.61; Table 6). Similar results were observed when considering only those patients from the independent NAC dataset (n=69) not used for GSC model training (Table 6). Overall, this analysis indicates that the outcome of patients with basal tumors can be improved most with NAC treatment.

TABLE 6

Results of Cox proportional hazard analysis of GSC's
ability to predict overall survival (NAC vs. Non-NAC)

| | MVA | | | MVA* | | | MVA* | | |
|---|---|---|---|---|---|---|---|---|---|
| | Non-NAC set (n = 476) | | | All NAC set (n = 269) | | | NAC Validation set (n = 69) | | |
| Variable | HR | 95% CI | p-value | HR | 95% CI | p-value | HR | 95% CI | p-value |
| Age | 1.02 | (1-1.05) | 0.066 | 1.01 | (0.99-1.04) | 0.235 | 0.98 | (0.93-1.03) | 0.433 |
| Female (Ref) | 1 | — | 1.000 | 1 | — | 1.000 | 1 | — | 1.000 |
| Male | 0.81 | (0.53-1.24) | 0.330 | 1.12 | (0.67-1.86) | 0.661 | 4.38 | (0.7-27.52) | 0.115 |
| Luminal (Ref) | 1 | — | 1.000 | 1 | — | 1.000 | 1 | — | 1.000 |
| Inf-Luminal | 2.38 | (1.33-4.28) | 0.004 | 2.46 | (1.29-4.7) | 0.006 | 5.68 | (0.4-81.3) | 0.201 |
| Basal | 2.22 | (1.34-3.68) | 0.002 | 0.84 | (0.42-1.68) | 0.614 | 0.88 | (0.16-4.94) | 0.881 |
| Claudin-Low | 3.06 | (1.71-5.47) | <0.001 | 2.16 | (1.22-3.81) | 0.008 | 3.73 | (0.81-17.25) | 0.092 |

*MVA models adjusted for institution and clinical stage

These results showed that NAC treatment in subjects with a basal subtype bladder cancer improves patient outcome. These results further showed that the subtyping methods of the present invention are useful for predicting benefit from neoadjuvant chemotherapy and treating a subject with bladder cancer. The results showed that the subtyping methods of the present invention may be used to determine a treatment for a subject with bladder cancer.

Example 2

Figure 4B:
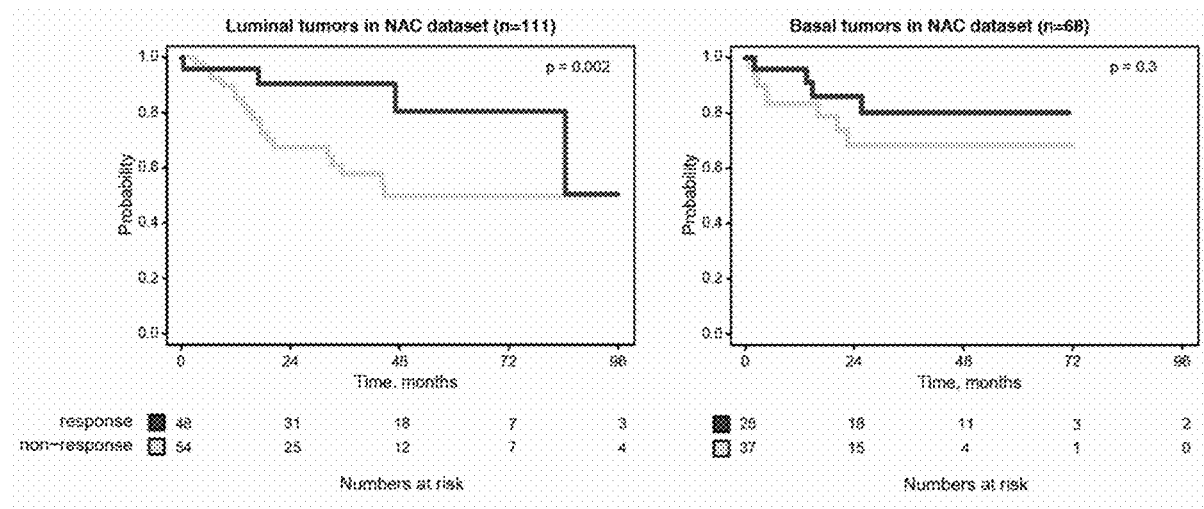
Figure 4C:
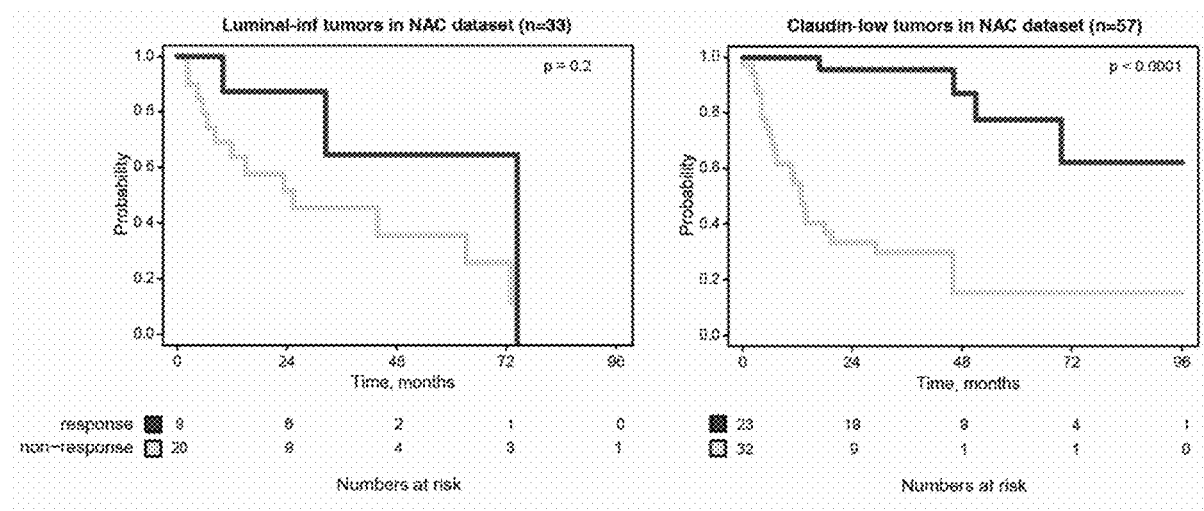
Figure 11:
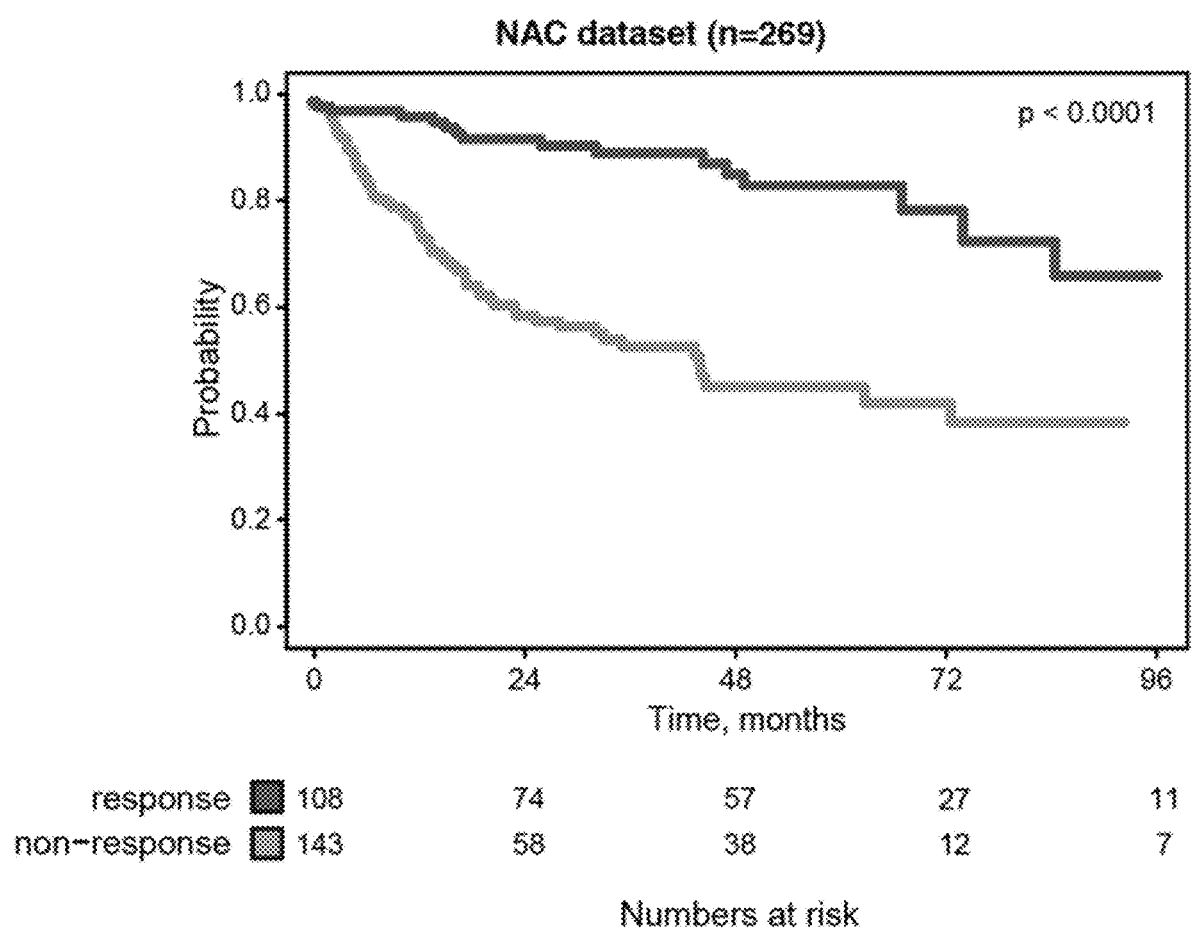
FIG. 11 shows the overall survival analysis in the NAC dataset according to response to NAC. A KM plot is shown of the OS according to response to NAC (response defined as <pT2N0).

NAC Survival Benefit in GSC Basal Tumors is Independent of Pathologic Response The relationship between NAC survival benefit in GSC basal tumors and pathological response was assessed as follows. The NAC cohort was analyzed using the subtyping methods described in Example 1. GSC was not significantly associated with major pathologic response (i.e., ypT<2N0) in the NAC cohort (Tables 4 and 7), even though major pathologic response was associated with improved OS (p<0.001) (FIG. 11 and Table 8). In an exploratory analysis, we further compared NAC responders (n=108) and non-responders (n=143) in each GSC subtype (FIG. 4B). Patients with luminal tumors who experienced a major response (n=46) had a 3-year OS of 95% (95% CI 89-100%) compared to 58% (95% CI 44-76%) in non-responders (n=47, p=0.002) (FIG. 4B upper left). In stark contrast, patients with GSC basal tumors did not show any significant differences in OS between major responders and non-responders (FIG. 4B upper right). The findings in the luminal infiltrated and claudin-low tumors were more similar to the luminal tumors (FIG. 4B lower panels).

TABLE 7

Logistic regression analysis of GSC's ability to predict
response to NAC (Cisplatin Based NAC set, n = 269)

| | UVA | | | MVA* | | |
|---|---|---|---|---|---|---|
| Variable | Odds Ratio | 95% CI | p-value | Odds Ratio | 95% CI | p-value |
| Age | 1 | (0.98-1.02) | 0.914 | 1 | (0.98-1.03) | 0.94 |
| Female (Ref) | 1 | — | 1.00 | 1 | — | 1.00 |
| Male | 1.52 | (0.87-2.64) | 0.139 | 1.48 | (0.82-2.64) | 0.192 |
| cT1&cT2 | 1 | — | 1 | 1 | (0.98-1.02) | 0.914 |
| cT3 | 0.77 | (0.44-1.32) | 0.336 | 0.76 | (0.4-1.45) | 0.404 |
| cT4 | 0.71 | (0.34-1.48) | 0.358 | 0.72 | (0.3-1.76) | 0.475 |
| Luminal (Ref) | 1 | — | 1 | 1 | — | 1.00 |
| Inf-Luminal | 0.53 | (0.22-1.28) | 0.161 | 0.61 | (0.24-1.57) | 0.307 |
| Basal | 0.93 | (0.5-1.73) | 0.82 | 0.93 | (0.48-1.81) | 0.834 |
| Claudin-Low | 0.83 | (0.43-1.6) | 0.572 | 0.92 | (0.46-1.85) | 0.821 |

*MVA model adjusted for institution

TABLE 8

Three-year overall survival rates for major responders
and non-responders within GSC subtypes

| | | Cisplatin-based NAC (n = 269) | | | |
|---|---|---|---|---|---|
| GSC Subtype | Non-NAC (n = 476) Overall | Overall | Re-sponders | Non-Responders | Log-rank p-value |
| Luminal | 76.60% | 74.7% | 95.2% | 57.6% | <0.001 |
| Inf-Luminal | 59.40% | 50.6% | 65.6% | 47.2% | 0.172 |
| Basal | 49.20% | 77.8% | 82.6% | 72.1% | 0.313 |
| Claudin-Low | 43.10% | 57.9% | 95.5% | 28.9% | <0.001 |

TABLE 9

Results of Cox proportional hazard analysis of GSC's
ability to predict overall survival in patients with NAC (n = 243)

| | MVA* | | |
|---|---|---|---|
| Variable | HR | 95% CI | p-value |
| Age | 1.01 | (0.99-1.03) | 0.483 |
| Female (Ref) | 1 | — | 1.000 |

TABLE 9-continued

Results of Cox proportional hazard analysis of GSC's ability to predict overall survival in patients with NAC (n = 243)

| | MVA* | | |
|---|---|---|---|
| Variable | HR | 95% CI | p-value |
| Male | 1.14 | (0.68-1.92) | 0.617 |
| Clinical Stage T1&T2 (Ref) | 1 | — | 1.000 |
| T3 | 1.48 | (0.83-2.65) | 0.185 |
| T4 | 1.69 | (0.82-3.47) | 0.152 |
| cN+ | 1.94 | (1.14-3.33) | 0.015 |
| Luminal (Ref) | 1 | — | 1.000 |
| Inf-Luminal | 2.5 | (1.3-4.8) | 0.006 |
| Basal | 0.9 | (0.44-1.83) | 0.767 |
| Claudin-Low | 2.26 | (1.24-4.1) | 0.008 |

*MVA models adjusted for institutions including Bern, NKI, UHS, UW, VGH, EMC; clinical node is not available in UCD.

These results showed that NAC survival benefit in GSC basal tumors is independent of pathologic response. These results further showed that the subtyping methods of the present invention are useful for predicting benefit from neoadjuvant chemotherapy and treating a subject with bladder cancer. The results showed that the subtyping methods of the present invention may be used to determine a treatment for a subject with bladder cancer.

Example 3

Development and Assessment of a Genomic Subtyping Classifier (GSC_RC) to Predict Molecular Subtypes in Muscle-Invasive Bladder Cancer A genomic subtyping classifier to predict molecular subtypes in muscle-invasive bladder cancer patients was developed and assessed as follows. A single sample model was trained to predict subtypes (Genomic Subtyping Classifier, GSC) using all pre-NAC TUR samples that passed QC, irrespective of chemotherapy regimen (n=223). The model was trained to predict four classes (claudin-low, basal, luminal-infiltrated and luminal). Unlike GSC_V1, these labels were generated using TURBT and RC samples.

To make the model applicable to several platforms, only genes on both Illumina HumanHT-12 V3.0 and Affymetrix Human Exon array 1.0 ST were selected as the initial gene list (17,007 genes). Using this initial gene set, the model development framework consisted of: 1) Feature selection, by which genes with low variance (variance <0.2) were removed, and significant genes were selected (p<0.001) using Kruskal-Wallis rank sum test; and 2) Model training with a generalized linear model with elastic net regularization (GLMNET) using the significant genes. These two steps were assessed using 10-fold cross-validation. Using the full training set, the feature selection step resulted in 298 genes, which were used to train the GSC_RC. GLMNET finally selected 162 genes to produce four scores. These scores, each ranging from 0 to 1, indicate the likelihood of the sample belonging to each of the four subtypes. The GSC_RC was independently validated in an 82 patient NAC validation dataset as well as in three non-NAC cohorts.

TABLE 10

The 162 Genes in the GSC_RC model with their coefficients

| Gene/Subtype | Claudin-low | Basal | Luminal | Luminal-infiltrated |
|---|---|---|---|---|
| Intercept | −6.95823 | 2.131339 | 3.175651 | 1.65124077 |
| LAMC2 | 0.976622 | 0 | 0 | 0 |
| IFI30 | 0.960598 | 0 | 0 | 0 |
| SAA1 | 0.82275 | −0.06162 | 0 | 0 |
| VIM | 0.787808 | 0 | 0 | 0 |
| TGFBI | 0.766984 | 0 | 0 | 0 |
| TIMP2 | 0.606912 | 0 | 0 | 0 |
| GBP1 | 0.526073 | 0 | −0.2393 | 0 |
| SNAI2 | 0.50705 | 0 | 0 | 0 |
| GBP5 | 0.457986 | 0 | 0 | 0 |
| POSTN | 0.379135 | −0.16632 | −0.00575 | 0 |
| TNC | 0.375036 | 0 | 0 | −0.235418787 |
| F3 | 0.363459 | −0.50552 | 0 | 0 |
| BGN | 0.359918 | −0.42863 | 0 | 0 |
| CCL5 | 0.233393 | 0 | −0.04296 | 0 |
| SULF1 | 0.229188 | 0 | 0 | 0 |
| WARS | 0.224574 | 0 | −0.25326 | 0 |
| MMP3 | 0.224215 | 0 | 0 | 0 |
| CXCL10 | 0.175088 | −0.05501 | 0 | 0 |
| TIMP3 | 0.154748 | −0.1268 | 0 | 0 |
| SERPINB1 | 0.146366 | 0 | 0 | 0 |
| DDIT4 | 0.134886 | 0 | 0 | 0 |
| MET | 0.089165 | −0.02577 | 0 | 0 |
| MYADM | 0.087209 | 0 | 0 | 0 |
| CD68 | 0.062788 | 0 | 0 | 0 |
| COL1A1 | 0.062049 | 0 | −0.11097 | 0 |
| ENO1 | 0.031846 | 0 | 0 | −0.388801186 |
| THBS1 | 0.031778 | 0 | 0 | 0 |
| CD44 | 0.029203 | 0 | 0 | 0 |
| MT1L | 0.007675 | 0 | −0.12182 | 0 |
| ACER2 | 0 | 0 | 0.254651 | 0 |
| ACOX1 | 0 | 0 | 0.344998 | 0 |
| ACSL5 | 0 | 0 | 0.056839 | 0 |
| ACTA2 | 0 | 0 | 0 | 0.184346006 |
| ACTG2 | 0 | 0 | 0 | 0.116816127 |
| AHR | 0 | 0 | 0 | 0.298753364 |
| AKR1C2 | 0 | −0.1062 | 0 | 0 |
| ANXA1 | 0 | 0.044244 | 0 | −0.023260537 |
| BAMBI | 0 | −0.05594 | 0 | 0.10127326 |
| BTG2 | 0 | −0.00806 | 0.169115 | 0 |
| CASP14 | 0 | 0.001236 | 0 | −0.333752276 |
| CDH1 | 0 | 0 | 0.488013 | 0 |
| CLDN1 | 0 | 0.113197 | 0 | 0 |
| COL1A2 | 0 | 0 | −0.02639 | 0 |
| CPSF6 | 0 | 0 | 0.54686 | 0 |
| CSTA | 0 | 0.068259 | 0 | 0 |
| CTSK | 0 | 0 | −0.76998 | 0 |
| CXCL1 | 0 | 0 | −0.18168 | 0 |
| CXCL9 | 0 | 0 | −0.35329 | 0 |
| CYP1A1 | 0 | 0 | 0 | 0.147248521 |
| DAPK1 | 0 | −0.41853 | 0 | 0 |
| DES | 0 | 0.00353 | 0 | 0 |
| DUSP1 | 0 | −0.19945 | 0 | 0.225606064 |
| EFEMP1 | 0 | 0.56878 | 0 | 0 |
| ERP27 | 0 | −0.0335 | 0 | 0.059116662 |
| F11R | 0 | 0 | 0.430938 | 0 |
| FCGR3A | 0 | 0 | −0.11616 | 0 |
| FLNA | 0 | 0 | −0.60018 | 0 |
| FN1 | 0 | 0 | −0.01906 | 0 |
| G0S2 | 0 | 0.231669 | 0 | 0 |
| GRHL1 | 0 | 0 | 0.181143 | 0 |
| HIST1H2AE | 0 | 0 | 0 | −0.204468813 |
| HIST1H2BF | 0 | 0.365323 | 0 | −0.332639794 |
| HLA-DRA | 0 | 0 | −0.00516 | 0 |
| HLA-DRB1 | 0 | 0 | −0.10826 | 0 |
| HLA-DRB5 | 0 | 0 | −0.1357 | 0.203470306 |
| HMGCS2 | 0 | 0 | 0.035475 | 0 |
| IFI16 | 0 | 0.282487 | −0.53556 | 0 |
| IFI6 | 0 | 0 | 0.21477 | 0 |
| IFITM2 | 0 | 0.168481 | −0.23749 | 0 |
| IGFL1 | 0 | 0 | 0 | 0.088865183 |
| INA | 0 | 0 | 0 | 0.269855096 |
| ITGA6 | 0 | 0 | 0 | −0.84448677 |
| KRT19 | 0 | 0 | 0.051028 | 0 |
| KRT8 | 0 | −0.07609 | 0 | 0 |

TABLE 10-continued

The 162 Genes in the GSC_RC model with their coefficients

| Gene/Subtype | Claudin-low | Basal | Luminal | Luminal-infiltrated |
|---|---|---|---|---|
| LAPTM5 | 0 | 0 | −0.14742 | 0 |
| LUM | 0 | 0 | 0 | 0.080477707 |
| LYZ | 0 | 0 | −0.14499 | 0.072869682 |
| MAL | 0 | 0 | 0 | 0.15591663 |
| MALL | 0 | 0.465878 | 0 | 0 |
| MMP1 | 0 | 0.052858 | 0 | 0 |
| MMP12 | 0 | 0.274163 | 0 | 0 |
| MT1E | 0 | 0 | −0.24211 | 0 |
| MYL9 | 0 | 0 | −0.79289 | 0 |
| OLFM4 | 0 | 0.092704 | −0.30198 | 0 |
| PABPC1 | 0 | −0.15484 | 0 | 0 |
| PAQR7 | 0 | −0.81694 | 0 | 0.085353834 |
| PERP | 0 | 0.119488 | 0 | −0.183724057 |
| PM20D1 | 0 | 0 | 0 | 0.334808319 |
| PPARG | 0 | 0 | 0.432215 | 0 |
| PSCA | 0 | 0 | 0 | 0.152192247 |
| PTMS | 0 | 0.155866 | −0.18937 | 0 |
| PTPN13 | 0 | 0 | 0.71945 | 0 |
| PTPRM | 0 | 0 | 0.799542 | 0 |
| RALBP1 | 0 | −0.33627 | 0.123879 | 0 |
| RNF128 | 0 | 0 | 0.355343 | 0 |
| RNF138P1 | 0 | 0 | 0.042225 | 0 |
| S100A10 | 0 | 0.036313 | 0 | 0 |
| S100A7 | 0 | 0 | −0.0635 | 0 |
| S100A8 | 0 | 0.061035 | −0.53246 | 0 |
| SAMD9 | 0 | 0.207082 | 0 | −0.093691035 |
| SCCPDH | 0 | 0 | 0.342716 | 0 |
| SCNN1A | 0 | 0.057514 | 0 | −0.31838232 |
| SCNN1B | 0 | −0.1988 | 0 | 0 |
| SCUBE2 | 0 | 0 | 0.014138 | 0 |
| SEMA5A | 0 | −0.233 | 0 | 0 |
| SERPINB13 | 0 | 0 | 0.015014 | 0 |
| SERPINB3 | 0 | 0.004895 | 0 | 0 |
| SERPINB4 | 0 | 0 | −0.0754 | 0 |
| SFN | 0 | 0 | 0.190208 | 0 |
| SFRP2 | 0 | 0 | −0.50451 | 0 |
| SLITRK6 | 0 | 0 | 0 | −0.066499889 |
| SNCG | 0 | 0 | 0 | 0.615705592 |
| SPINK1 | 0 | 0 | 0 | 0.142190603 |
| SPP1 | 0 | 0.041592 | 0 | −0.112347072 |
| SPRR1B | 0 | 0.309708 | 0 | 0 |
| STS | 0 | −0.0029 | 0.175825 | 0 |
| SYTL2 | 0 | 0 | 0 | 0.04313459 |
| TACSTD2 | 0 | −0.13378 | 0.340548 | 0 |
| TGM2 | 0 | 0.262799 | 0 | 0 |
| THBS2 | 0 | 0 | −0.37458 | 0 |
| TMEM45A | 0 | 0.9048 | 0 | 0 |
| TMEM45B | 0 | 0 | 0.392412 | 0 |
| TMPRSS2 | 0 | 0 | 0.071859 | 0 |
| TMSB10 | 0 | 0.015045 | 0 | −0.063996697 |
| TOX3 | 0 | −0.1094 | 0 | 0 |
| TPM2 | 0 | 0 | −0.68009 | 0 |
| TPX2 | 0 | 0.291045 | 0 | −0.113275851 |
| TWIST2 | 0 | 0.094704 | −0.57787 | 0 |
| UPK1A | 0 | −0.14054 | 0 | 0.18918717 |
| UPK1B | 0 | 0 | 0.05864 | 0 |
| VCAN | 0 | 0 | −0.57477 | 0 |
| VGLL1 | 0 | −0.45263 | 0.527312 | 0 |
| VSIG2 | 0 | 0 | 0.072273 | 0 |
| ZNF486 | 0 | 0 | 0 | 0.053892023 |
| UGT1A1 | −0.00506 | 0 | 0 | 0 |
| BEX4 | −0.00708 | 0 | 0 | 0 |
| UGT1A9 | −0.03392 | 0 | 0 | 0 |
| CXCL17 | −0.04011 | 0 | 0 | 0 |
| IGFBP3 | −0.04219 | 0 | 0.130155 | 0 |
| UGT1A3 | −0.04299 | 0 | 0 | 0 |
| UGT1A5 | −0.04733 | 0 | 0 | 0 |
| SLC14A1 | −0.05549 | 0 | 0 | 0.006087454 |
| GPR110 | −0.06705 | 0 | 0 | 0 |
| TNFRSF21 | −0.06924 | 0 | 0 | 0 |
| FLRT3 | −0.0772 | 0 | 0 | 0 |
| ELF3 | −0.07776 | 0 | 0.5981 | 0 |
| S100P | −0.13041 | 0 | 0 | 0 |
| GATA3 | −0.13428 | 0 | 0.005371 | 0 |
| UGT1A10 | −0.15895 | 0 | 0 | 0.014614392 |
| GABRP | −0.16184 | 0.823325 | 0 | 0 |
| GRHL3 | −0.1895 | −0.02293 | 0 | 0.377913673 |
| MACC1 | −0.26694 | 0 | 0.000789 | 0 |
| EHF | −0.26857 | 0 | 0 | 0 |
| UGT1A8 | −0.27341 | 0 | 0 | 0 |
| MGP | −0.29176 | 0.055706 | 0 | 0 |
| ERBB2 | −0.33678 | 0 | 0.083101 | 0 |

Validation of GSC RC to Predict Molecular Subtypes

Figure 12:
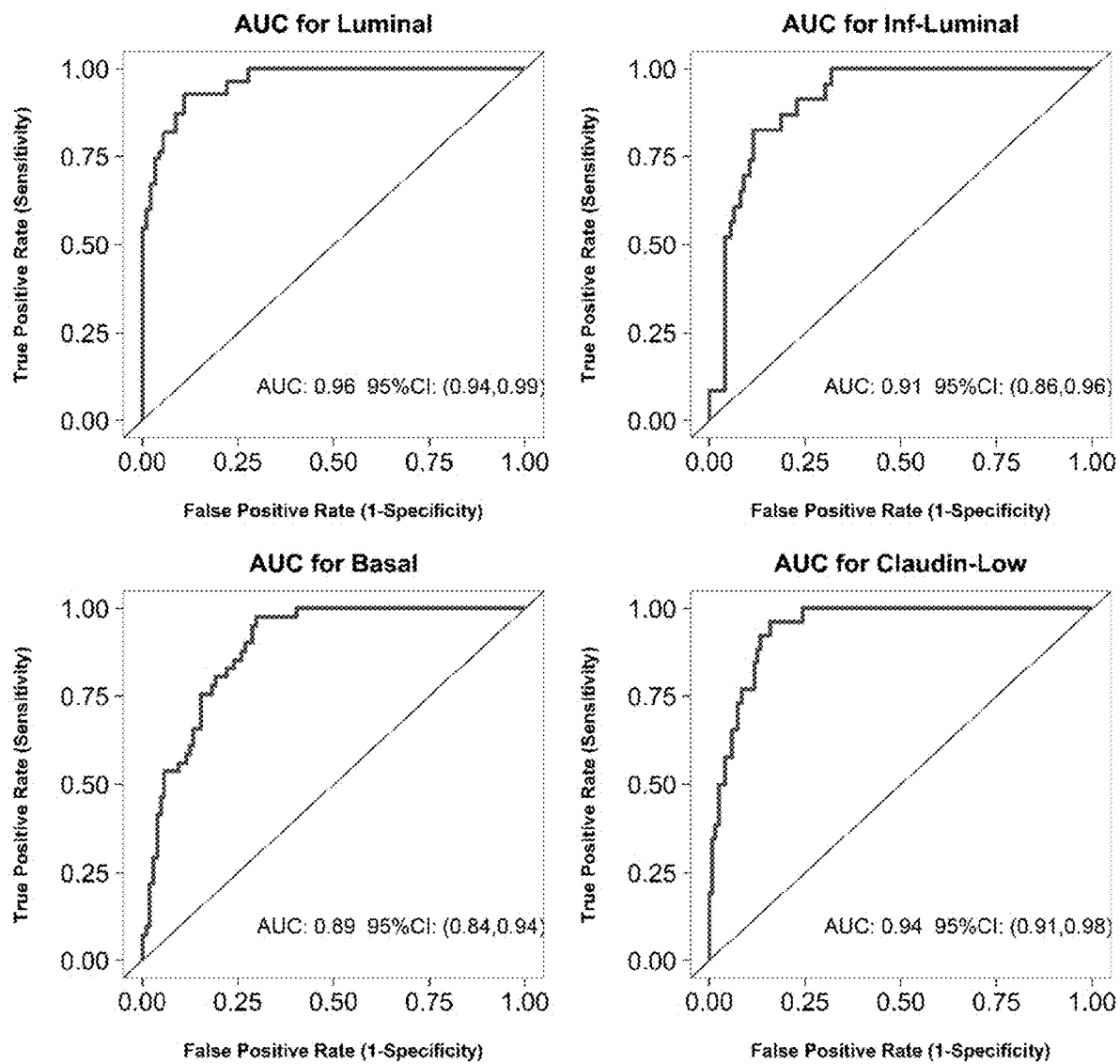
FIG. 12 shows the area under the curve (AUC) for four molecular subtypes of the present invention.

In the validation cohort, the average accuracy was 72% in predicting molecular subtypes (See Table 11). Moreover, as shown in FIG. 12 the Area Under Curve (AUC) for claudin-low, basal, luminal-infiltrated, and luminal was 0.94, 0.89, 0.91, and 0.96, respectively. These results showed that methods of the present invention are useful for predicting molecular subtypes for subject with muscle-invasive bladder cancer. These results suggested that the methods of the present invention may be useful for predicting benefit from neoadjuvant chemotherapy and treating a subject for bladder cancer.

TABLE 11

Confusion matrix showing GSC_RC predictions compared to labels of the validation data

| | | Reference | | | |
|---|---|---|---|---|---|
| | | Luminal | Inf_Luminal | Basal | Claudin_Low |
| Prediction | Luminal | 51 | 12 | 3 | 0 |
| | Inf_Luminal | 2 | 10 | 3 | 0 |
| | Basal | 2 | 1 | 29 | 11 |
| | Claudin_Low | 0 | 0 | 6 | 15 |

Accuracy: 0.72

Prediction of Response to NAC and Overall Survival

Figure 13:
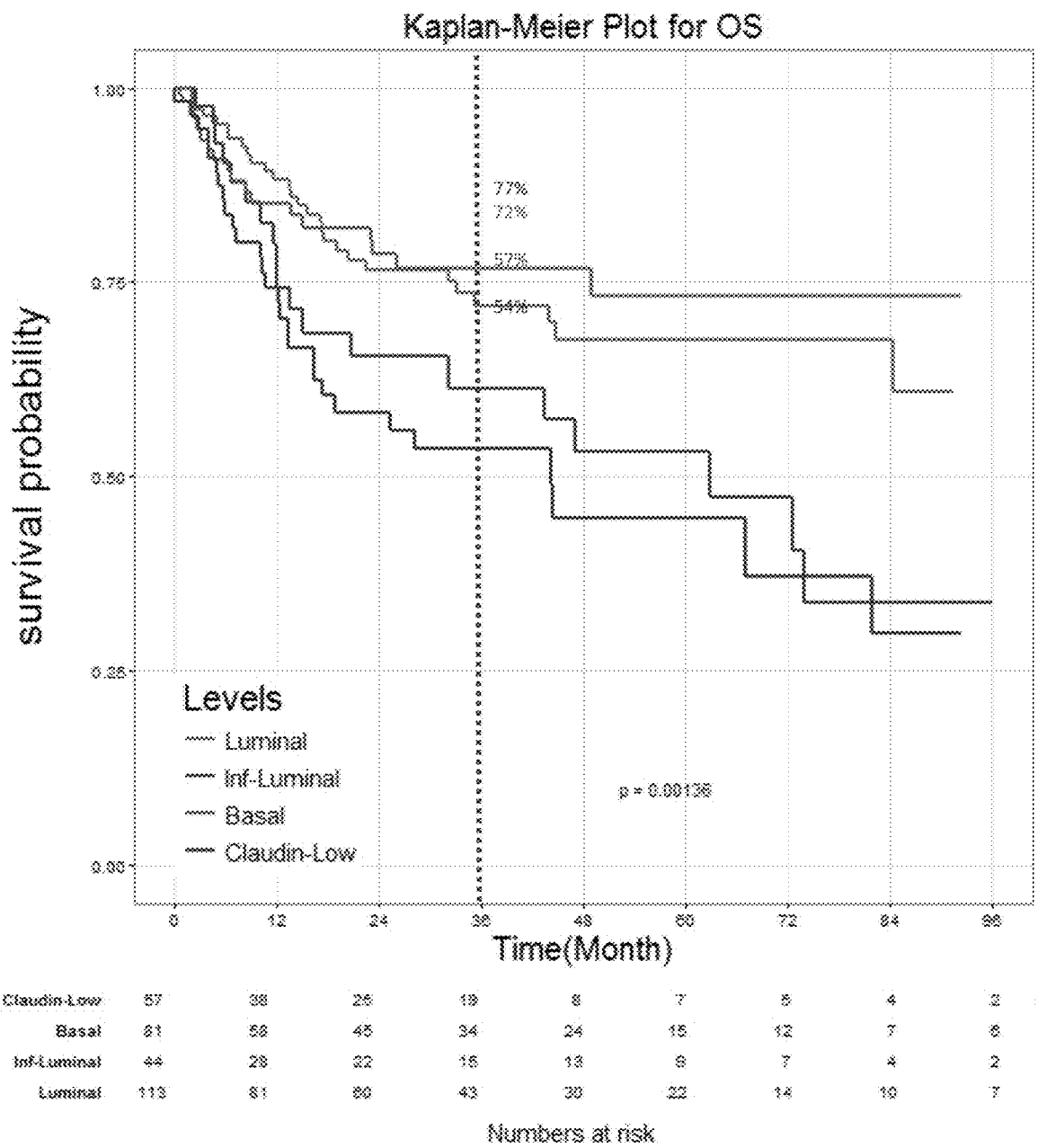
FIG. 13 shows survival analysis of a genomic subtyping classifier of the present invention. The Kaplan Meier curve shows survival probability for each subtype in NAC.

The relative changes in outcome by GSC_RC molecular subtype in bladder cancer patients treated with NAC is shown below in FIG. 13. Bladder cancer Patients with GSC had a 3-year OS rate of 77%, 72%, 57%, and 54% in the NAC cohort for basal, luminal, Inf-luminal, and Claudin-low. In multivariable analysis adjusting for clinical age and gender in the NAC cohort, patients had a hazard ratio of 1.71, 0.81, and 2.18 (p=0.08, p=0.49, p=0.004; Table 12), respectively. These results showed that the methods of the present invention are useful for predicting benefit from neoadjuvant chemotherapy and treating a subject for bladder cancer. These results further showed that the methods of the present invention are useful for determining a treatment for a subject who has bladder cancer.

TABLE 12

Cox Regression - Multivariable

| | HR | 95% CI | p-value |
|---|---|---|---|
| Luminal (ref) | 1 | — | 1 |
| Inf-Luminal | 1.71 | (0.94-3.1) | 0.08 |
| Basal | 0.81 | (0.44-1.48) | 0.49 |
| Claudin_Low | 2.18 | (1.28-3.71) | 0.004 |
| Age | 1.02 | (0.99-1.04) | 0.14 |
| Gender-F (ref) | 1 | — | 1 |
| Gender-M | 1.07 | (0.67-1.71) | 0.77 |

TABLE 12-continued

Cox Regression - Multivariable

|  | HR | 95% CI | p-value |
|---|---|---|---|
| Bern (ref) | 1 | — | 1 |
| NKI | 0.70 | (0.37-1.33) | 0.28 |
| UHS | 0.77 | (0.35-1.7) | 0.52 |
| UW | 0.67 | (0.34-1.29) | 0.23 |
| VGH | 0.72 | (0.37-1.43) | 0.35 |
| UCD | 0.77 | (0.31-1.94) | 0.59 |
| EMC | 0.67 | (0.3-1.48) | 0.32 |

While the preferred embodiments of the invention have been illustrated and described, it will be appreciated that various changes can be made therein without departing from the spirit and scope of the invention.

TABLE 13

Subtyping Target Sequences

| SEQ ID NO. | Gene | Affy Probeset ID | Sequence |
|---|---|---|---|
| 1 | GRHL3 | 2325371 | TGGGAACCTACCTGTCAGCAAAATCTCGACACCCAAACCTCAACATAAATCAAACACTTTCCC GGGCAGAGAATGTCTGTGTCAGGCAAGAATTAGAGACAAGCGGTCAGCAGAGCCTCA |
| 2 | GRHL3 | 2325372 | ACATCGGTGGATACCTGCCGCTCTCAGAGCGTGGAGGCTGGATGGGGTTTCCTGGAGGGGG AAGAGCGGGGAGGCCGGCACCGGGATTCACAGAGCAATTTGTAAGGGTAAATGAATGGGCT GACGATCTTACTTTGGCGTGTCAAGGCAAGC |
| 3 | GRHL3 | 2325374 | AGGAGATGTGCCAAACTGTTAAGAGTGGTTATTTCTGAGCAGAAGA |
| 4 | GRHL3 | 2325375 | ATGTGGATGAATTCCATTCTTCCTATTTTTC |
| 5 | GRHL3 | 2325382 | TGTGCGGCTGCTAAAGAACGACCCAGTCAACTTGCAGAAATTCTCTTACACTAGTGAGGATGA GGCCTGGAAGACGTACCTAGAAAACCCGTTGACAGCTGCCA |
| 6 | GRHL3 | 2325383 | GAGATGATGACAGTGTTGCGGCCTTGAGCTTCCTCTATGATTACTACA |
| 7 | GRHL3 | 2325385 | GAGAAGCGGATATTGTCCTCCAGCACTGGG |
| 8 | GRHL3 | 2325386 | TGAGACGGACCTCACTCCCCTTGAAAGCCCCACACACCTCATGA |
| 9 | GRHL3 | 2325387 | TCAAGAAGAATAACCTGATGAGCTTGGAGGGGGCCTTGCCCACCCCTGGCAAGGCAGCTCCC CTCCCTGCAGGCCCCAGCAAGCTGGAGGCCGGCTCTGTGGACAGCTACCTGTTACCCACCACT GATATGTATGATAATGGCTCCCTCAACTCCTTGTTTGAGAGCATTCATGGGGTGCCGCCCACA CAGCGCTGG |
| 10 | GRHL3 | 2325389 | AGCAAGTCTGTAACATAGCCTCAGGC |
| 11 | GRHL3 | 2325390 | TGACTTTGAATACACCCTGGGCTCCCCCAAAGCCATCCACATCAAGTCAGGCGAGTCACCCAT GGCCTACCTCA |
| 12 | GRHL3 | 2325391 | AGTGTGGTGATGGTTGTCTTCGACAATGAGAAGGTCCCAGTAGAGCAGCTGCGCTTCTGGAA GCACTGGCATTCCCGGCAACCCACTGCCAAGCAGCGGGTCATTGAC |
| 13 | GRHL3 | 2325392 | AAGAAAACTTCAACACTGTGGAGCACATTGAGGAGGTGGCCTATAATGCACTGTCCTTTG |
| 14 | GRHL3 | 2325394 | GTGTTCATCGGCGTAAACTGTCTGAGCACAGACTTTTCCTCACAAAAGGGGGTGAAGGGTGT CCCCCTGAACCTGCAGATTGACACCTATGACTGTGGCTTGGGCACTGAGCGCCTGGTACACCG TGCTGTCTGCCAGATCAAGATCTTCT |
| 15 | GRHL3 | 2325397 | AGGAAGATGCGCGATGACGAGCGGAAGCAGTTCCGGAGGAAGGTCAAG |
| 16 | GRHL3 | 2325398 | CAATGAGACGACCTACCTTCGGCCAGAGACTGACCTGGAGACGCCACCCGTGCTGTTCATCCC CAATGTGCACTTCTCCAGCCTGCAGCGCTCTGGAGGG |
| 17 | GRHL3 | 2325399 | TCAGCCAGTTTCAAGACCTTTATTGAATCATAGGGGTTTAAACATGTATATATGGTCCTATAGC TTCAGTGACCTATTGTATTGAAGAGAAGAATGTTATGAAGAAACAGATTTCGTAACCATTAAA ACGTTCATGCTTAGGGCA |
| 18 | GRHL3 | 2325403 | TTCTGCTGTATGTGCGGAGGGAGACTGAGGAGGTGTTTGACGCGCTCATGTTGAAGACCC |
| 19 | GRHL3 | 2325405 | CTTAGTCAACATGGACAACAACATCATTCAGCATTACAGCAACCACGTCGCCTTCCTGCTGGA CATGGGGGAGCTGGACGGCAAAATTCAGATCATCCTTA |
| 20 | GRHL3 | 2325406 | GCCTCAGCGCTGTTACTTGAATGCCTTCCCTGAGGGAAGAGGCCCTTGAGTCACAGACCCACA GACGTCAGGGCCAGGGAGAGACCTAGGGGGTCCCCTGGCCTGGATCCCCATGGTATGCTTG AATCTGCTCCCTGAACTTCCTGCCAGTGCCTCCCCGTACCCCAAAACAATGTCACCATGGTTAC CACCTACCCAGAAGACTGTTCCCTCCTCCCAAGACCCTTGTCTGCAGTGGTGCTCCTGCAGGCT GCCCGTTAAGATGGTGGCGGCACACGCTCCCTCCCGCAGCACCACGCCAGCTGGTGCGGCCC |

TABLE 13-continued

Subtyping Target Sequences

| SEQ ID NO. | Gene | Affy Probeset ID | Sequence |
|---|---|---|---|
|  |  |  | CCACTCTCTGTCTTCCTTCAACTTCAGACAAAGGATTTCTCAACCTTTGGTCAGTTAACTTGAAA ACTCTTGATTTTCAGTGCAAATGACTTTTAAAAGACACTATATTGGAGTCTCTTTCTCAGACTTC CTCAGCGCAGGATGTAAATAGCACTAACGATCGACTGGAACAAAGTGACCGCTGTGTAAAAC TACTGCCTTGCCACTCACTGTTGTATA |
| 21 | GRHL3 | 2325407 | CACCTGACTGTCTTGAATGTTCCCATCCTGTGACTCAAGTGAGGAACATGGGTTTTGGAGATG GATTTTGGAGGCAGAGGGACCTGGATTCAAATCCCAGCCCCACCACCGTCAACAGCCTGCAC TTCACTGTAAACTCGGAATGACACACCCACCTGGAGGAGAGGTGGAAGGACGACGGCAGGT CACATCTGAGAGCTCTCAGCTCAGAGTATGTGG |
| 22 | SFN | 2326775 | AGAGACACAGAGTCCGGCATTGGTCCCAGGCAGCAGTTAGCCCGCCGCCCG |
| 23 | SFN | 2326776 | CGCTATGAGGACATGGCAGCCTTCATGAAAGGCGCCGTGGAGAAGGGCGAGGAGCTCTCCT GCGAAGAGCGAAACCTGCTCTCAGTAGCCTATAAGAACGTGGTGGGCGGCCA |
| 24 | SFN | 2326777 | AGCTCCAGGGCGTGTGCGACACCGTGCTGGGCCTG |
| 25 | SFN | 2326778 | CACCGGTGACGACAAGAAGCGCATCATTGACTCAGCCCGGTCAGCCTACCAGGAGGCCATGG ACATCAGCAAGAAGGAGATGCCGCCCACCAACCCCATCCGCCTGGGCCTGGCCCTGAACTTTT CCGTCTTCCACTACGAGATCGCCAACAGCCCCGAGGAGGCCATCTCTCTGGCCAAGACCACTT TCGACGAGGCCATGGCTGATCTGCACACCCTCAGCGAGGACTCCTACAAAGACAGCAC |
| 26 | SFN | 2326779 | ACCCTGCCGAGAGGACTAGTATGGGGTGGGAGGCCCCACCCTTCTCCCCTAGGCGCTGTTCTT GCTCCAAAGGGCTCCGTGGAGAGGGACTGGCAGAGCTGAGGCCACCTGGGGCTGGGGATCC CACTCTTCTTGCAGCTGTTGAGCGCACCTAACCACTGGTCATGCCCCCACCCCTGCTCTCCGCA CCCGCTTCCTCCCGACCCCAGGACCAGGCTACTTCTCCCCTCCTCTTGCCTCCCTCCTGCCCCTG CTGCCTCTGATCGTAGGAATTGAGGAGTGTCCCGCCTTG |
| 27 | SFN | 2326780 | TGCGCGCGCGCCAGTGCAAGACCGAGATTGAGGGAAAGCATGTCTGCTG |
| 28 | CYP4Z2P | 2335016 | TCCTGGCTTCAGGAACTCATGGCTCACCCCTTCTTGCTGCTGATCCTCCTCTGCATGTCTCTGCT GCTGT |
| 29 | CYP4Z2P | 2335018 | CTTGTGGGTTGGACCCTTTACGATGTTCTTCA |
| 30 | CYP4Z2P | 2335028 | CGAGGACTTGTGACCCTGGATGGTTCTAAATGGAAAAAGCACCGCCAGATTGTGAAACCTGG CTTCAACATCAGCATTCTGAAAATATTCATCACCATGATG |
| 31 | CYP4Z2P | 2335030 | TGGGAGGAACACATTGCCCAAAACTCACGTCTGGAGCTCTTTCAACATGTCTCCCTGATGAC |
| 32 | CYP4Z2P | 2335031 | CCCTGGACTCATACCTGAAAGCAGTGTTCAACCTTAGCAAAATCTCCAACCAGCGCATGAACA ATTTTCTACATCACAACGACCTGGTTTTCAAATTCAGCTCTCAAGGCCAAATCTTTTCTA |
| 33 | CYP4Z2P | 2335032 | AGTAATCCAGGACCGGAAGGAGTCTCTTAAGGATAAGCTAAAACAAGATACTACTC |
| 34 | CYP4Z2P | 2335034 | ATGTGCATCAAGGAATGCCTCCGCCTCTACG |
| 35 | CYP4Z2P | 2335035 | TAGTAAACATATCCCGGTTACTCGACAA |
| 36 | CYP4Z2P | 2335042 | CTGTGTTTATCAATATTTGGGCTCT |
| 37 | GBP1 | 2345792 | TTCATCAGGAGTTCCTTCAAAGATGTGGACCATCTATTTCAAA |
| 38 | GBP1 | 2345852 | AGAGATCCACATGACAGGCCCAATGTGCCTCATTGAGAACACTAATGGGCGACTGATGGCGA ATCCAGAAGCTCTGAAGATCCTTTCTGCCATTAC |
| 39 | GBP1 | 2345856 | GTGCAGTCTCACACTAAAGGAATCTGGATGTGGTGTATGCCCCATCCCAAGAAGCCAGGCCA CATCCTAGTTCTGCTGGACACCGAGGGTCT |
| 40 | GBP1 | 2345862 | GACAAACAGGAACACCTGCTTACAGCC |
| 41 | GBP1 | 2345863 | CAGACATACTTGAAATCCAAGGAGTCTATGACTGATGCAATTCTCCAGACAGACCAGACTC |
| 42 | GBP1 | 2345864 | GAAAGCTGAGTCTGCACAGGCTTCAGCAAAAATGTTGCAGCAAATGCAAAGAAAGAATGAG CAGATGATGGAACAGAAGGAGAGGAGTTATCAGGAACACTTGAAACAACTGACTGAGAAGA TGGGAGAGCGACAGGGTCCAGTTGCTGGAAGAGCAAGAGAGGACCCTCGCTCTTAAACTTCAG |
| 43 | GSTM2 | 2350953 | TCTGGGCCTCTCACAAACGCTGAGCCCCGCCCCGCTGAGGCCTGTCTGCAGAATCCACAGCAA CCAGC |
| 44 | GSTM2 | 2350958 | GTAATGGCACCCTCGAGTCTGGGCCCTGCCCC |
| 45 | GSTM2 | 2350959 | CCCGTCTGGGTAATTATGATGGGTGTCCCTCAGGGCT |

TABLE 13-continued

Subtyping Target Sequences

| SEQ ID NO. | Gene | Affy Probeset ID | Sequence |
| --- | --- | --- | --- |
| 46 | GSTM2 | 2350960 | CTCCTGATTATGACAGAAGCCAGTGGCTGAATGAAAAATTCAAGCTGGGCCTG |
| 47 | GSTM2 | 2350963 | GGTACATTGCCCGCAAGCACAACCTG |
| 48 | GSTM2 | 2350964 | AGCAGATTCGCGAAGACATTTTGGAGAACCAGTTTATGGACAGCCGTATGCAGCTGGCCAAA<br>CTCTGCTATGACCCAGATT |
| 49 | GSTM2 | 2350965 | CCTTTCCCTGCAGAGTTTGTGTCCAAAATTGATTCCTTCTGGTGAGTTCTTGGTCTTGCTGACTC<br>TAAGAATGAAGCCGCGGTCCTACACGGTGAGTGTTACAGTTCTTAAAGATGGTGTGTCCGGA<br>GTTTGTTCCTTCAGATGTTCAGATGTGTCCGCAGTTTCTTCCTTCCGGTGGGTTTGTGGTCTTG<br>CTGACTTCAGGGGTGAAGCCGCAGACCTTCGCAGTGAGTGCTACAGCTCTTAAAGGTGGCGC<br>GTCTGGAGTTGTTTATTCCTCTTGGTGGGTTCATGGTCTGGCTGGCTTCAGGAGTGAAGCTGC<br>AGACCTTCATAGTGAATGTTATAGCTCATAAAGGTAGTTCAAACCCAAAGAGTGAGCAACAG<br>CAGGATTTATGGTGACGAGTGAA |
| 50 | GSTM2 | 2350970 | GAGAAACTGAAACCAGAATACCTGCAG |
| 51 | GSTM2 | 2350973 | GGATTTCATCGCTTATGATGTCCTTGAGAGAAA |
| 52 | GSTM2 | 2350975 | CTCCCAAGACCTGTGTTCACAAAGA |
| 53 | GSTM2 | 2350976 | CCTTCCTGTTAGTGGTTGTGTCTGCTTTAAAGGGCCTGCCTGGCCCCTCGCCTGTGGAGCTCA<br>GCCCCGAGCTGTCCCCGTGTTGCATGAAGGAGCAGCATTGACTGGTTTACAGGCCCTGCTCCT<br>GCAGCATGGTCCCTGCCTTAGGCCTACCTGATGGAA |
| 54 | GSTM2 | 2350978 | GTCTCTGATGATTACGCTCAAGGTATTCTCCTTCATATGTTAGCTTTTGAGAATGCGAACCATG<br>AGTGTAAAGTGGTCATGCGTTCTGTCTAATGACAAAATTTACCTGATCACGAGGTGTGCCTGC<br>ATATATTAAAGCTTGTGAAAGCATTGGATCAGAGACCCACAAAGCTATTCTGTGGGCACGGG<br>CCATGAAGGATGGCAATCAAACTGGCTTGACTGAATTCTTTTCTTGGAGCCTGCTATAATTGT<br>GGTCAACTTCATCATACCCAAAAAAATTGCACTGTTAAAAGCGGCCAAGCCAGCTCAACAAAC<br>ATGGCCAAATGCTCCTGCTACTGTTTGCCCTCATTGTCGTAAAGGTAAACACTGGGCAAGTAC<br>TTGCCACTCTAAGTCTGATATAGATGGCAATCCCTTGCCACAGAACCAGGGAAATGGGAAGC<br>AGGGCCAGTCCCAGGCCCCAGTATCAAATGGGACACCTCAGACTCAGACCAATATTGTGTTTC<br>TGCTTCAAGCGGTCCCAATACAGCCCCCAGCACAAGCAAATTTACCTACAGCCAACCCAGATG<br>GGTCCCAGTCGCTTCTTCTGTCTCAGTACAATGCTTGTCTACCTCCACAGTAGGGGCAGGGC<br>GGTCAATCTCTGTAGTACCACTCCTCTAAATTTACTACCGAATTCTTTGCCTTTAATTGTCCCCA<br>CGGGGGCCACTGGCCCTTTACCTCAAGGTTTGGTGGGCCTGGTGTTAGGTAGGGCATCCACC<br>TCTGCTAAAGGTATCATAGTTCATACTGGTCTCATTAATTCTGATTCCTCTGATGAGATTAAAA<br>TAATCGTGTCTGCCAAGGTTCCTGTTTCCATTCCGGCCAGTGAGTCAATTGCTCAACTACTTTT<br>ACTACCTAATATTGTTTTAAACAAAGGAGATAAGACAGGGGGCCCTGGGATGGGCTCTGGCG<br>GTGAAAAAGCCGCTTATTGGATTAAAGTAATTTCTAAACAACAGCCCACCTGCACCATACATA<br>TTAAAGGAAAAAAGTTTGAGGGCCTAGTAGATACTGGGGCTGATGTTTCTATTATTTCCTCTA<br>ATTTATGGCCTTCTTCCTGGCTTAAACATCCCACTAACATGGGACTAGTAAGGGTTGGAAAAG<br>CTGATGAAGTTCACCAAAGCACATTTATCTTGCCTTGCACTGGGCCTGATGGTCAAAAGGGAA<br>CAATTCAGCCTTATATCATGCCAATCCCCATTAATCTTTGGGGTAGATATTTGCTGGAACAATG<br>GGGGGCTGAAATTAATATTCCACATAACTCTTCTCGTGCTCCCAGTCAACATATAATGGAAAA<br>CGTGGGGACTGTTCCTGGACTCAGTCTCGGTCCAAAACATGAAGGAATTACTAAATTCCTTTA<br>TGGTTTAAAAGCATAATTTAACCACTCCCCACTCCCAATTCCATTTAGCATTGTTTACTTTAAAC<br>TTTCTAAATGTTCCTAAAGACAATACTCTGACTGCAGCCGAACACCATTATACAGGCAAAAAA<br>TTCTCCCTAAATGAAAGCAAGCCAGTGTTATGGAAAAACTCCCAGACAAATACCTGGGAACCT<br>GGAACAATTATAATGTGGGAAGAGGGTATGCTTGTGTTTCACCAGGAGATCATCAATCCCC<br>TGTCTGGGTGCCCACTAGAAGACTTTAACTTCGTGTGAATACTGACAATGAAAAACACAGGG<br>AAGAGATGTCCACGTCAGAGACTGCCCTCATACCTGGTGAGATCTGTGCCAACTCCTCAAAAA<br>CTGGCACACCAAATCAAATGGATCTCATTCAATCCTCCCTAATGGCAACAGAGACCCCTCTA<br>ACTAATCCCACTTCTCCTAATTACCTTTCTTTTTCTCCTTACAAACCTGAAAATCTCACCATTTCT<br>ATTAGCCTGAAAATAACATCCCTCTGTTCTTCTCTTCCTCCTTCAGCACTGGATCTCGCTTACAA<br>TAGGTTTTATTTAATAATTCTACTCCTTATACTTTCTGTCTCACCAGTTTCCCCTCACACTGATTT<br>GCCTGCTACACAAAATTATTCTTATTGGGCTTATGTGCCTTTTCCTCCACTTATTCGACCTCTCA<br>CCTGGATGAATGCTCCTGCGGAAATCTACACTAACGATAGTGTGTAGATGCCTGGAGCTATA<br>GATGACCATTGCCCTGCTCAACCAGGAGAAGAAGGCACTGCATTTAATGTTACTATGGGTTAT<br>AAATACCCTCCTCTGTGCCTCGGACATGCAACTCGTTGTATCCATCTAGAAACTCAAGTCTGGG<br>CTGCTTATCTTCTGGAGAGATTAGCTACAGGAAAATGGGGACATTTGGTCTCCGGCCTCTCCC<br>TTTGTCCTTTAAGACAAATGAAAGGGGAGTAATAGGAGATACCCCATACTTTCAATATAAAC<br>CTGTAGGAAAACTATGTCCTAAAAATTTTGAGGGCCCATCTAAAACTTTAATTTGGGGAGATT<br>GTGTTAACTCACATGCAGTAGTATTAAAAAATGACTCATATGCTTTAGTAATAGACTGGGCAC<br>CAAAGGGCTATTTAAAAAACACTTGCTCCTCTGGGGAGGGGAATTCCTGGAGGCTACTTATT<br>TTATTTCTTATTGGGAGGACGAGGATCATCATCCTACTTTGCATAGGTGGTTCGGCTCATT |
| 55 | GSTM2 | 2350979 | GAATCTGGATACTGTGTGCCGGACCAGCCAAAGAATCCTGTGTCAAAACCGAGAGAACGAATA |
| 56 | GSTM2 | 2350982 | AGCCCTGCTCGGTTTAGGCCTGTCTGCGGAATCCGCACCAACCAG |
| 57 | GSTM2 | 2350983 | TGCCCATGATACTGGGGTACTGGGACATCCGCG |

TABLE 13-continued

Subtyping Target Sequences

| SEQ ID NO. | Gene | Affy Probeset ID | Sequence |
|---|---|---|---|
| 58 | GSTM2 | 2350984 | CCCTCCATCTCTGACGCGACCTGCGGGCCATCT |
| 59 | GSTM2 | 2350985 | TGGAATACACAGACTCAAGCTATGAGG |
| 60 | GSTM2 | 2350986 | GTAATGGCACCCTCGTGTTCGGGCTCTGCCCACTCA |
| 61 | GSTM2 | 2350987 | TGCTGGAGCTGCAGGCTGTCTCTTCCCTGAGCC |
| 62 | GSTM2 | 2350990 | AAAGTGCAACGTGTCTCTGACTGCATCTCCTCTCCCAGCTTAGAGGTGTTAAGATCAGGAGT CTTCTGCCCAATTCCTCTCACTCCTGGCTGTCTAAACAGTCCTTCCATGATGTTCTGTGTCCACC TGCATTCGTTCATGTGACA |
| 63 | GSTM2 | 2350991 | AGCCTGGTGGCCCAACTGAGCTTCGCCGGTTTCCCATCCATCCAG |
| 64 | GSTM2 | 2350993 | CATGGACAACCATATGCAGCTGGGCATGATCTGCTACAATCCA |
| 65 | GSTM2 | 2350994 | AAACTGAAGCCAAAGTACTTGGAGGAACTCCCTGA |
| 66 | GSTM2 | 2350997 | CTCGTCTATGATGTCCTTGACCTCCACCG |
| 67 | GSTM2 | 2350998 | CTCCCAAGACCTGTGTTCTCAAAGATGGCTGTCTGGGGCAACA |
| 68 | GSTM2 | 2350999 | GAGTGAGGAGCCCATACTCAGCCTGCTGCCCAGGCTGTGCAGCGCAGCTGGACTCTGCATCC CAGCACCTGCCTCCTCGTTCCTTTCTCCTGTTTATTCCCATCTTTACTCCCAAGACTTCATTG |
| 69 | GSTM2 | 2351000 | CCTTCCTGTTAGTGGTTGTGTCTGCTTTAAAGGGCCTGCCTGGCCCCTCGCCTGTGGAGCTCA GCCCCGAGCTGTCCCCGTGTTGCATGAAGGAGCAGCATTGACTGGTTTACAGGCCCTGCTCCT GCAGCATGGTCCCTGCCTTAGGCCTACCTGATGGAA |
| 70 | SPRR1B | 2359522 | CCAGTTCTAAGGGACCATACAGAGTATTCCTCTCTTCACACC |
| 71 | SPRR1B | 2359523 | CCCACCCCCTCAGCTTCAGCAGCAGCA |
| 72 | SPRR1B | 2359525 | CCCAAAGTGCCCGAGCCCTGCCAGCCCAAGGTTCCAGAGCCATGCCACCCCAAG |
| 73 | SPRR1B | 2359526 | TGAGCCCTGCCCTTCAATAGTCACTCCAGCACCAG |
| 74 | SPRR1B | 2359527 | GCGTATGAGTCCCATTTGCCTTGCAATTAGCATTCTGTCTCCCCCAAAAAAGAATGTGCTATGA AGCTTTCTTTCCTACACACTCTGAGTCTCTGAATGAAGCTGAAGGTCTTAGTACCAGAGCTAGT TTTCAGCTGCTCAGAATTCATCTGAAGAGAGACTTAAGATGAAAGCAAATGATTCAGCTCCCT TATACC |
| 75 | S100A7 | 2359694 | GAGCAACACTCAAGCTGAGAGGTCCATAATAGGCATGATCGACATGTTTCACAAATACACCG GACGTGATGGCAAGATTGAGAAGCCAAGCCTGCTGACGATGATGAAGGAGAACTTCC |
| 76 | IFI16 | 2362396 | CCAAGTCTTGACTGAGAAACGGACCGGGCAGATGAGGGACTCCCACATATACCTGTTTCCTG CTCTTCCCGAAGACATTTTGCCACAAGCATATAATTCAGCTTCTGAAAAATACGGTCTTCCTCA CTGCAGACACCATGCCAGCGTTTTAAATCAAGTTGGCTACTCGTGCTGTTTA |
| 77 | IFI16 | 2362397 | AGTATGCAGTTTGCCTGTGGCAATATTAAACTCATCTGGAAGAAAGCACTTAAACCTATCCAG TTCCTCATCGGTGATGTTATCCAGGCTG |
| 78 | IFI16 | 2362398 | GTTAGCAAGAGTATCTCCTTATATTTACTCTCCATCTCACGACTTTTCAGCTTATAAGGGATCCA AACTATGTAAGATTATACCACCAAAAGTGATTCAACATTC |
| 79 | IFI16 | 2362403 | CACGCTAAAGGGCACCCACTGTCCTTAACAG |
| 80 | IFI16 | 2362404 | CTACCGGAAGTTCAGTGCATTTTCCAGGATTTTCAAGTCTTCGATGCTGTCATGTTGAGAGTCC ACTATCCACGTTTGTTTATCCAGGA |
| 81 | IFI16 | 2362405 | TGGGGCAATAGCAGAATAGGAGCAAGCCAGCACTAGTCAGCTAACTAAGTGACTCAACCAAG GCCTTTT |
| 82 | IFI16 | 2362406 | TTCTTAGCGTTTCTGGAGATTACAACATCCTGCGGTTCCGTTTCTGGGAACTTTACTGATTTAT CTCCCCCCTCACACAAATAAGCATTGATTCCTGCATTTC |
| 83 | IFI16 | 2362407 | TCTACTAAAAGGATTAGAGGTCATCAATGATTATCATTTTAGAATGGTTAAGTCCTTACTGAG |
| 84 | IFI16 | 2362408 | ATTTTCGAAGATATACCAACGCTTGAAGACCTGGCT |
| 85 | IFI16 | 2362409 | TGCTGGTCTCCTTAAGGCCAGGCTGGGCTAATGCAGTAGAGCTAGACTAAAGCACAGCTGAA CCCTCAAGCAGGAACTGAGAGCAAATTGTATTGAAACTGCTTCAG |
| 86 | IFI16 | 2362410 | CTGTCGGAGATCGTTTATATGTCTTCCTT |

TABLE 13-continued

Subtyping Target Sequences

| SEQ ID NO. | Gene | Affy Probeset ID | Sequence |
|---|---|---|---|
| 87 | IFI16 | 2362411 | CTCCACAAGCAGCACTGTCAAAACTGAAG |
| 88 | IFI16 | 2362413 | AAGGTGTCCGAGGAACAGACTCAGCCTCCCTCTCCTGCAGGAGCCGGCATGTCCACAGCCAT GGGCCGTTCCCCATCTCCCAAGACCTCATTGTCA |
| 89 | IFI16 | 2362416 | ACCCGAAAACAGTGGCCAAATGTCAGGTAACTCCCAGAAGAAATGTTCTCCAAAAACGCCCA GTGATAGTGAAGGTACTGAGTACAAC |
| 90 | IFI16 | 2362422 | ACCACAATCTACGAAATTCAGGATGATAGAGGAAAAATGGATGTAGTGGGGACAGGACAAT GTCACAATATCCCCTGTGAAGAAGGAGATAAGCTCCAACTTTTCTGCTTTCGACTTAGAA |
| 91 | IFI16 | 2362428 | CCCAAGAGCATGAAGCTACCCCAGGAACAGCGTCAGCTTCCATATCCTTCAGAGGCCA |
| 92 | IFI16 | 2362435 | CAGATACTGAAGGAAGGGAGTCATTTTCCAGGACCGTTCATGACCAGCATAGGCCCAGCTGA GAGCCATCCCCACACTCCTCAGATGCCTCCATCAACACCAAGCAGCAGTTTC |
| 93 | IFI16 | 2362439 | CAGATACTGAAGGAAGGGAGTCATTTTCCAGGACCGTTCATGACCAGCATAGGCCCAGCTGA GAGCCATCCCCACACTCCTCAGATGCCTCCATCAACACCAAGCAGCAGTTTC |
| 94 | IFI16 | 2362442 | CTGAAGAAGTTTCCATAGAAGACAGTGCCCAGAGTGACCTCAAAGAAGTGATGGTGCTGAAC GCAACAGAATCATTTGTATATGAG |
| 95 | IFI16 | 2362443 | TTTCATGCCACAGTGGCAACTGAGAATGAAGTCTTCCGAGTGAAG |
| 96 | IFI16 | 2362444 | TCACACTTGTGGCTGATGTGAATGCTGACCGAAACATGGAGATCCCAAAAGGATTGATTAGA AGTGCCAGCGTAACTCCTAAAATCAATCAGCTTTGCTCACAAACTAAAGGAAG |
| 97 | IFI16 | 2362445 | GTAAGCCCACACCATTGTTTTATAAAATTTCTCCTGCAACCTCCAATTTTTAAAGTCTTAACTTG TCAACTGGAGTTT |
| 98 | IFI16 | 2362446 | CTTGTCCAGGACAGTGCAGAGTTTATATCAACACACATATCCTTAGGATTTTGTTTCTTTGAGT TCTTCTCCATCTGTATCAATGACAACTTAATTTAATTGTGAATAAAAGAGTTGCTCTCCCAAGC CTGAATCCTGATTGTGACAACCAGAGTAAGAAATAAAATAGACTACTCTGCTTTAGAATGCAG CTATGTCTAACAGTTAGCTAGAATTCTGATCATTTGGACTCCAAAGTTTCTTGCCTCTTCTCATT CATTAATTCATCAGGAGACTGTAGAGCAACTAACTTCTGCATTAAATAATAAGAGAAATACGA AGCAAAAAGACTAAAAAAGTCACGTAGCTTAACTGCTCAATTTATAAATGGGGCAATAAAAT GCAAAAAAAGAAAAAAAGCTTGGTGAATTCTTAGGCTTACAGTGTGCCTTTCAGTCTCTACA CATCATGTAAATATTATGCTTAGCTGATTTAACTTCTTGTTTGAAGTACTGTTTCATACTCCATT ATACATGTCTTCTAGGGTGGCTTACTTTTAATTGTGCTGTTTTCTCTACACTCAGTTTAAATGAC TGTACATATATATGTGGTTGTAGAGTTAATGAATAATGAGCTACAAACCAGAACAATGTGACT AGATAGATAGGATGATCTAGATTTGAGATCTGGGCAGATTGGGAAAGAGTGACTATATGGA GAAGAAAGAAGTAGTTACATATTGAAATAACAGTCTACTTAATGAGGACGTGCAACATTCTTT CTCAAACTTACAAAGTGCCATAAAAAGCCTCTATTCTCTGCTCTTGGGCAGGTGTGAAAGAAA CCTACCAAATTAATCAGATTTTTCTGTATCCAGGCTCCTTA |
| 99 | IFI16 | 2362447 | GGTGCATGGACGACTGACCACAATCAACTGTGAGGAAGGAGATAAACTGAAACTCACCTGCT TTGAATTGGCACCGAAAAGTGGGAATACCGGGGAGTTGAGATCTGTAATTC |
| 100 | IFI16 | 2362450 | GTCATCAAGACCAGGAAAAACAAGAAAGACATACTCAATCCTGATTCAAGTATGGAAACTTC ACCAGACTTTTTC |
| 101 | IFI16 | 2362451 | TGGATGTCATTGACGATAATGTTTATGGAGATAAGGTCTAAGTGCCTAAAAAAATGTACATAT ACCTGGTTGAAATACAACACTATACATACACACCACCATATATACTAGCTGTTAATCCTATGGA ATG |
| 102 | IFI16 | 2362452 | TCTACAACTTCTATAATTTGAAAAA |
| 103 | LAMC2 | 2371146 | CTGCCTCTGCTTCTCGCTCCTCCTGCCC |
| 104 | LAMC2 | 2371152 | CTCTTAGTGCTCGATGTGACAACTCCGGACGGTGCAGCTGTAAACCAGGTGTGACAGGAGCC AGATGCGACCGATGTCTGCCAGGCTTCCACATGCTCACGGATGCG |
| 105 | LAMC2 | 2371153 | CAAGTGTGACTGTGACCCAGCTGGCATCGCAGGGCCCTGTGACGCGGGCCGCTGTGTCTGCA AGCCAGCTGTCACTGGAGAACG |
| 106 | LAMC2 | 2371155 | TCAGGTTACTATAATCTGGATGGGGGAACCCTGAGGGCTGTACCCAGTGTTTCTGCTATGG GCATTCAGCCAGCTGCCGCAGCTCTGCAGAATACAGTGTCCATAAGATCACCTCTACCTTTC |
| 107 | LAMC2 | 2371157 | CAACGAAATGGGTCTCCTGCAAAGCTCCAATGGTCACAGCGCCATCAAGATGTGTTTAGCTCA GCCCAACGACTAGACCCTGTCTA |

TABLE 13-continued

Subtyping Target Sequences

| SEQ ID NO. | Gene | Affy Probeset ID | Sequence |
|---|---|---|---|
| 108 | LAMC2 | 2371158 | GCCTGTCCTTTGACTACCGTGTGGACAGAGGAGGCAGACACCCATCTGCCCATGATGTGATTC<br>TGGAAGGTGCTGGTCTACGGATCACAGCTCCCTTGATGCCACTTGGCAAGACACTGCCTTGTG<br>GGCTCACCAAGACTTA |
| 109 | LAMC2 | 2371159 | AGCTGAGTTACTTTGAGTATCGAAGGTTACTGCGGAATCTCACAGCCCTCCGCATCCGAGCTA<br>CATATGGAGAATA |
| 110 | LAMC2 | 2371160 | ATGTCCTGTTGGGTACAAGGGGCAATTCTGCCAGGATTGTGCTTCTGGCTACAAGAGAGATTC<br>AGCGAGACTGGGGCCTTTTGGCACCTGTATTCCTTGTAACTGTCA |
| 111 | LAMC2 | 2371161 | AGAATCCTGACATTGAGTGTGCTGACTGCCCAATTGGTTTCTACAACGATCCGCACGACCCCC<br>GCAGCTGCAAGCCATGTCCCTGTCATAACGGGTTCAGCTGCTCA |
| 112 | LAMC2 | 2371162 | GTGTGCAATAACTGCCCTCCCGGGGTCAC |
| 113 | LAMC2 | 2371164 | CCCTTTGGTGAACATGGCCCAGTGAGGCCTTGTCAGCCCTGTCAATGCAACAACAATGTGGAC<br>CCCAGTGCCTCTGGGAATTGTGACCGGCTGACAGGCAGGTGTTTGAAGTGTATCCACAACAC<br>AGCCGGCATCTACTGCGACCAGTGCAAAGCAGGCTACTTCGGGGACCCA |
| 114 | LAMC2 | 2371165 | CCATGGGCTCAGAGCCTGTAGGATGTCGAAGTGATGGCACCTGTGTTTGCAAGCCAGGATTT<br>GGTGGCCCCAACTGTGAGCATGGAGCATTCAGCTGTCCAGCTTGCTATAATCA |
| 115 | LAMC2 | 2371166 | ATGGATCAGTTTATGCAGCAGCTTCAGAGAATGGAGGCCCTGATTTCAAAGGCTCAGGGTGG<br>TGATGGAGTAGTACCTGATACAGAGCTG |
| 116 | LAMC2 | 2371167 | GTGCTAGCAGATCCCTTGGTCTCCAGTTGGCCAAGGTGAGGAGCCAAGAGAACAGCTACCAG<br>AGCCGCCTGGATGACCTCAAGATGACTGTGGAAAGAGTTCGGGCTCTGGGAAGTCAGTACCA<br>GAACCGAGTTCGGGATACTCACA |
| 117 | LAMC2 | 2371169 | CCTCAGACCACTACGTGGGGCCAAATGGCT |
| 118 | LAMC2 | 2371170 | CCACGTTGAGTCAGCCAGTAACATGGAGCAACTGACAAGGGAAACTGAGGACTATTCCAAAC<br>AAGCCCTCTCACTGGTGCGCAAGGCCCTGCATGAAGGAGTCGGAAGCG |
| 119 | LAMC2 | 2371171 | CCCTGGCCCAGCAGTTGACAAGGGAGGCCACTCAAGCGGAAATTGAAGCAGATAGGTCTTAT<br>CAGCACAGTCTCCGCCTCCTGGATTCAGTGTCTCGGCTTCA |
| 120 | LAMC2 | 2371172 | AGAGGATCAAACAAAAAGCGGATTCACTCTCAAGCCTGGTAACCAGGCATATGGATGAGT |
| 121 | LAMC2 | 2371174 | CTGCTTTCCCGTGCCAATCTTGCTAAAAGCAGAGCACAAGAAGCACTGAGTATGGGCAATGC<br>CACTTTTTATGAAGTTGAGAGCATCCTTAAAAAC |
| 122 | LAMC2 | 2371175 | GGCCCTGGAAATCTCCAGTGAGATTGAACAG |
| 123 | LAMC2 | 2371176 | ATCGACATGTGTGTTGGTGCCAGTAGCACCAAACACAAGGGTGGTGTGGAGGGAAAAAGAA<br>CATTGAGCTTATTTTAACCTCTGAGGCTCAGAGCCCTGTTGTGGCCCATGGGAGCCCCAGATT<br>AAAAGACTATGGTAGCAAAGACGCATGACAGAGAATGATGTGTTTTTTTGTCCTCCGGGTTTT<br>CCCAAATGGTTCCTAACTCTGTTCAACATTTGGTGAGCATTGAACTGAGAGAAGCACTGTC<br>TGGCCGCTGACCTTCCTAGTCATACCCCCAGATTAGCTTGTTTGAGGCAGAGCTTGGCAAAGT<br>ACCCCTGTCCCTAAGTCTGATTCTCTCATTATTCATCTAATTTACTCCATCAGGGCCCGGCTGCC<br>GCTGTATTTTTTCTA |
| 124 | LAMC2 | 2371178 | CCCAGAAGGTTGATACCAGAGCCAAGAACGCTGGGGTTACAATCCAAGACACACTCAACACA<br>TTAGACGGCCTCCTGCA |
| 125 | LAMC2 | 2371179 | CCCTGTTTTACCGTTGCTAAGATGGGTCACTGAACACCTATTGCACTTGGGGGTAAAGGTCTG<br>TGGGCCAAAGAACAGGTGTATATAAGCAACTTCACAGAACACGAGACAGCTTGGGAATCCTG<br>CTAAAGAGTCTGGCCTGGACCCTGAGAAGCCAGTGGACAGTTTTAAGCAGAGGAATAACATC<br>ACCACTGTATATTTCAGAAAGATCACTAGGGCAGCCGAGTGGAGGAAAGCTTGAAGAGGGG<br>GTTAGAGAGAAGGCAGGTTGAGACTACTTAAGATATTGTTGAAATAATTGAAGAGAGAAATG<br>ACAGGAGCCTGCTCTAAGGCAGTAGAATGGTGGCTGGGAAGATGTGAAGGAAGATTTTCCC<br>AGTCTGTGAAGTCAAGAATCACTTGCCGGCCGGGTG |
| 126 | LAMC2 | 2371182 | GGAGCAGAAGCTTTCCCGAGCCAAGACCCAGATCAACAGCCAACTGCGGCCCATGATGTCAG<br>AGCTGGAAGAGAGGGCACGTCAGCAGAGGGCCACCTCCATTTGCTGGAGACAAGCATAGA<br>TGGGATTCTGGCTGATGTGAAGAACTTGGAGAACATTAGGGACAACCTGCCCCCAGGCTGCT<br>ACAATACCCAGGCTCTTG |
| 127 | LAMC2 | 2371183 | TCTCAACTGAGGTTCTTGGGATACAGATCTCAGGGCTCGGGAGCCATGTCAT |
| 128 | LAMC2 | 2371184 | GTTTAATGGGTATGCTCAGGTCAACTGACCTGACCC |
| 129 | LAMC2 | 2371185 | GTGGTTGTCTTATTGCACCATACTCCTTGCTTCCTGATGCTGGGCAATGAGGCAGATAGCACT<br>GGGTGTGAGAATGATCAAGGATCTGGACCCCAAAGAATAGACTGGATGG |

TABLE 13-continued

Subtyping Target Sequences

| SEQ ID NO. | Gene | Affy Probeset ID | Sequence |
|---|---|---|---|
| 130 | LAMC2 | 2371186 | TAAGTGGAGTCCTGGAATTTGGACAAGTGCTGTTGGGATATAGTCAACTTATTCTTTGAGTAATGTGAC |
| 131 | LAMC2 | 2371187 | TTCTTGCTGATCAGAGTTCCTCCTACTTACAACCCAGGGTGTGAACATGTTCTCCATTTTCAAGCTGGAAGAAGTGAGCAGTGTTGGAGTGAGGACCTGTAAGGCAGGCCCATTCAGAGCTATGGTGCTTGCTGGTGCCTGCCACCTTCAAGTTCTGGACCTGGGCATGACATCCTTT |
| 132 | LAMC2 | 2371188 | AAAGTGTGGCTTGGGCATTGAAAGAGGTAAAATTCTCTAGATTTATTAGTCCTAATTCAATCCTACTTTTCGAACACCAAAAATGATGCGCATCAATGTATTTTATCTTATTTTCTCAATCTCCTCTCTCTTTCCTCCACCCATAATAAGAGAATGTTCCTACTCACACTTCAGCTGGGTCACATCCATCCCTCCATTCATCCTTCCATCCATCTTTCCATCCATTACCTCCATCCATCCTTCCAACATATATTTATTGAGTACCTACTGTGTGCCAGGGGCTGGTGGGACAGTGGTGACATAGTCTCTGCCCTCATAGAGTTGATTGTCTA |
| 133 | LAMC2 | 2371189 | GAACATATGTTGCAAGACCCTCCCATGGGGGCACTTGAGTTTTGGCAAGGCTGACAGAGCTCTGGGTTGTGCACATTTCTTTGCATTCCAGCTGTCACTCTGTGCCTTTCTACAACTGATTGCAACAGACTGTTGAGTTATGATAACACCAGTGGGAATTGCTGGAGGAACCAGAGGCACTTCCACCTTGGCTGGGAAGACTATGGTGCTGCCTTG |
| 134 | CFH | 2373338 | ATTTGCCTTATGTTATGGGCTATTTGT |
| 135 | CFH | 2373340 | ATTCTGACAGGTTCCTGGTCTGACCAAACATATCCAGAAGGCACCCAGGCTATCTATAAATGCCGCCCTGGATATAGATCTCTTGGAAATGTAATAATGGTATGCAGGAAGGGAGAATGGGTTGCTCTTAATCCATTAAGG |
| 136 | CFH | 2373341 | TTAATATTGTAGCAATTATGCCTGAATTATATCACTATTGCCAGTC |
| 137 | CFH | 2373342 | TGGACATCCTGGAGATACTCCTTTTGGTACTTTTACCCTTACAGGAGGAAATGTGTTTGAATATGGTGTAAAAGCTGTGTATACA |
| 138 | CFH | 2373344 | CAATTGCTAGGTGAGATTAATTACCGTGAATGTGACACAGATGGATGGACCAAT |
| 139 | CFH | 2373345 | GTCAGTAGTGCAATGGAACCAGATCGGGAATACCATTTTGGACAAGCAGTACGGTTTGTATGTAACTCAGGCTACAAGATTGAAGGAGATGAAGAAATGCATTGTTCAGACGATGGTTTTTGGA |
| 140 | CFH | 2373346 | CTGAGGAAATCTTGGCTAAATAGTGATGACACAAAAACAGGTCAGTTACTTTTCAGAGATGTAATGACAATGAGTTAAATCAATGTCTTTGACAAAAAGTCCTGTTGATAATTCCTGTCTTATCAATAACTAGAAGATGTGTTATTTTTGCAGGTCATTCAGTGAAAACATCACAATAAAACTATATTTATGATCAATTTTATTTATACAGTTGATGAATGTTACTGGTCACTATTTATTTCAAGAAGGCTAATTTATCCTGAAACTAAATAAAATCAGAAGCATAATTTTAATCAGAATTTTAACTTTCTTCAGATAAATCATTTATTAAGCGGTCAAGTCAAAACAGAACTTTTGTTTGGTTGACTGATTTACCTGATGGAAACAACATTTCTGTTTTCATATAATTATGTCCTGGTCACAGTCCTTTAATTTGC |
| 141 | CFH | 2373347 | AATGGATCTCCTATATCTCAGAAGATTATTTATAAGGAGAATGAACGATTTCAATATAAATGTAACATGGGTTATGAATACAGTGAAAGAGGAGATGCTGTATGCACTGAATCTGGATGGCGTCCGTTGCCTTCATGTGAA |
| 142 | CFH | 2373349 | AAATGGTGACTACTCACCTTTAAGGATTAAACACAGAACTGGAGATGAAATCACGTACCAGTGTAGAAATGGTTTTTATCCTGCAACCCGGGGAAATACAGCAAAATGCACAAGTACTGGCTGGATACCTGCTCCGAGAT |
| 143 | CFH | 2373352 | GGTCTATATCATGAGAATATGCGTAGACCATACTTTCCAGTAGCTGTAGGAAAATATTACTCCTATTACTGTGATGAACATTTTGAGACTCCGTCAGGAAGTTACTGGGATCACATTCATTGCACACAAGATGGATGGTCGCCAGCAGTACCA |
| 144 | CFH | 2373353 | TTTGTACAGGGTAAATCTATAGACGTTGCCTGCCATCCTGGCTACGCTCTTCCAAAAGCGCAGACCACAG |
| 145 | CFH | 2373354 | ATGGCTGGTCTCCTACTCCCAGATG |
| 146 | CFH | 2373364 | CTTCTGATCGAAGGTCATCCCTCTCCAGCTTGAGTGGATCAAAGATGACAAGGGCCAATGGAACCAAGTTTGAGTCTTGCCAGGTCAATACTTGGGTCCTGAGTATGGTGACTAGTATCTGTTTTTGTTATGTGTGTATTATTCCAGCCAGAATGGGAAATGCTAATTCAGCTCCTCCAGG |
| 147 | CFH | 2373371 | AACAGCAGATGGTGAAACATCAGGAT |
| 148 | CFH | 2373373 | CCTGATCGCAAGAAAGACCAGTATAAAGTTGGAGAGGTGTTGAAATTCTCCTGCAAACCAGGATTTACAATAGTTGGACCTAATTCCGTTCAGTGCTACCACTTTGGATTGTCTCCTGACCTCCCAATATGTA |
| 149 | CFH | 2373377 | AGCAAGTACAATCATGTGGTCCACCTCCTGAACTCCTCAATGGGAATGTTAAGGAAAAACGAAAGAAGAATATGGACACAGTGAAGTGGTGGAATATTATTGCAATCCTAG |

TABLE 13-continued

Subtyping Target Sequences

| SEQ ID NO. | Gene | Affy Probeset ID | Sequence |
|---|---|---|---|
| 150 | CFH | 2373378 | TAATGAAGGGACCTAATAAAATTCA |
| 151 | CFH | 2373379 | CCTGTGGAGATATACCTGAACTTGAACATGGCTGGGCCCAGCTTTCTTCCCCTCCTTATTACTATGGAGATTCAGTGGAATTCAATTGCTCAGAATCATTTACAATGATTGGACACAGATCAATTACGTGTATTCATGGAGTATGGACCCAACTTCCC |
| 152 | CFH | 2373381 | CTTAAGAAGTGCAAATCATCAAATTTAATTATACTTGAGGAACATTTAAAAAACAAGAAGGAATTCGATCATAATTCTAACATAAGGTACAGATGTAGAGGAAAAGAAGGATGGATACACACAGTCTGCA |
| 153 | CFH | 2373382 | TGGCACAAATACAATTATGCCCACCTCCACCT |
| 154 | CFH | 2373383 | GAAGATGGCAGTCAATACCACTCTG |
| 155 | CFH | 2373384 | CCTCAGATAGAACACGGAACCATTAATTCATCCAGGTCTTCACAAGAAAGTTATGCACATGGGACTAAATTGAGTTATACTTGTGAGGGTGGTTTCA |
| 156 | CFH | 2373385 | GATTTCTCATGGTGTTGTAGCTCACATGTCAGACAGTTATCAGTATGGAGAAGAAGTTACGTACAAATGTTTTGAAGGTTTTGGAATTGATGGGCCTGCAATTGCAAAATGCTTAGGAGAAAA |
| 157 | CFH | 2373386 | TATTCTTCATTCAAAGTGTAAGTGGTACCAATAAGAAAGTAAACAGGGACTCTAGAAATTCATAAGGTTTTCTTGAATATTCTGGACTGCTGTGGGAAATTATAGCTGTAGTAATT |
| 158 | CFH | 2373387 | TGTGAACTTTAAGCATCCTCTGATGTATATTCTCAGACTTCTCATCTCTGTTCTTAGGGCACAGCTGCCTCTACTCATCAATCTCCACATTATTCAATCTTCTGTCAGTTTATCAACAATCTGCCTATAAGTACATTTTCTGAAATATTTTAAAAAATCATTATAAGTATTTCACATTTGATAGAAGCAAAAAATTTGGAAATGCACACACAATATAGGTGGTGTATTATTCCGTTTTCACACTGCTGTAAAGACCTTCCTGAGACTGGGTAATTTATAAAAGAAAAAATTTTAATTGATCACAGTTCCTCATGACTGAGGAGGTGTCATGAAACTTACCATTACCGCTGAAGGGAAGCAGGCACCTTCTTCACAAGGTGGCAGGAGAGAGAGGAGTGAGTGAAGGAGGAACTTCTAAACAGTTATTAAATCATCATATCTTGTGAGAACTCACTCACCATCGTGAGAACAGCATGTGGGAAACTGCCACCATGATCCAATCACTTCCCACCAGGTCTCTCTCTCAACACCTGGAGATTATTATTCAAGATGAGATTTGGGTGAGGACACAAAGCCTAACCATATCAGGTGGCAAGTATGGACAAAAATAATGTGAACAAAAAAATGTGTAATCTCAATTGCTACGGCTACCAATATTTCTTCAG |
| 159 | CFH | 2373388 | CAGATTGTCTCAGTTTACCTAGCTTTGAA |
| 160 | CFH | 2373389 | AGCAAGTGACTTACACTTGTGCAACATATTACAAAATGGATGGAGCCAGTAATGTAACATGCATTAATAGCAGATGGACAGGA |
| 161 | CFH | 2373391 | ACACCTCCTGTGTGAATCCGCCCACAG |
| 162 | CFH | 2373392 | ACGTTATCAATGTAGGAGCCCTTATGAAATGT |
| 163 | CFH | 2373394 | TCCCGTTGTCAGTATATGCTCCAGCTTCATCAGTTGAGTACCAATGCCAGAACTTGTATCAACTTGAGGGTAACAAGCGAATA |
| 164 | CFH | 2373396 | TCCGTGTGTAATATCCCGAGAAATTATGGAAAATTATAACATAGCATTAAGGTGGACAGCCAA |
| 165 | CFH | 2373397 | TTGAATTTGTGTGTAAACGGGGATA |
| 166 | CFH | 2373398 | AACTGGAGTATCCAACTTGTGCAAAA |
| 167 | CFH | 2373435 | TCCCGTTGTCAGTATATGCTCCAGCTTCATCAGTTGAGTACCAATGCCAGAACTTGTATCAACTTGAGGGTAACAAGCGAATA |
| 168 | CFH | 2373437 | AACTGGAGTATCCAACTTGTGCAAAA |
| 169 | CFH | 2373438 | TTATTCAGAACTTTAGTATTAAATCA |
| 170 | CFH | 2373439 | TATTCATACGTAAAATTTTGGATTAATTTGTGAAAATGTAATTATAAGCTGAGACCGGTGGCTCTCTTCTTAAAAGCACCATATTAAA |
| 171 | CFH | 2373445 | ACCATACTTTCCAGTAGCTGTAGGAA |
| 172 | ELF3 | 2375012 | GAAGCCGGTTCTCCCACATTCCTGGGTGAGGGACTGGGTGGAGGGTGTGCCTGCCTCAGGCTCCTTGGGGGAGGCCCCCTGAAGGGCTGGGAAAATCCTACTGAGCCCCAGGCTCTCCTGCCTGCACTGGCCCAGTGCGGGGCGGGGGGCGGGGGATCCTGGACATTAACTCTCTCCTAGGCACCTGGGAGCTTCAGAGAGGAAGAAGGTAAGGTAAGAAGCAGATTCTCTGCGCAGGACTTTCTTAGTCCTCAGGCTATAGAGTTAAAGAAAGAAGTATCTGTAGAAGGTGGAGTCACCTTTTGTTTGAGTAACCGTTTCACCCACCCTGGCTGAGGGTGGCCAGGAACTCCCCAAGTTGTGCATTAATGGAGGGGGTCACACAGATCCTACATTTTTTGTTTTGTTTTTTTTTTTGAGACGCAGTGATTACAGGTGTGAGCCACCGGATCCTACATTTCAAATGCATAAAAATCTAGATATGGGCTGGGCGCAGTAGCTCATGCCTGTAATCCCAGCACTTTGGGAGGCTGAGGCAGGCAGATCATGAGG |

TABLE 13-continued

Subtyping Target Sequences

| SEQ ID NO. | Gene | Affy Probeset ID | Sequence |
|---|---|---|---|
| | | | TCAGGAGATCGAGTCCATCCTGGCTAACATGGTGAAACCCCGTCTCTACTAAAAATACAGAAA
GCCGGGCATGGCAGCGGGCGCCTGTAATCCCAGCTACTCGGAAAGCTGAGGCAGGAGAATC
GCTTGAACCCAGGAGTCAGAGGTTGCAGTGAGCAGAGATCACGCCACTGCACTCCAACCTGG
GCGACAGAGCGAGACTCCACCTCAAAACAAAATAAACAAAATACTAGATCTGGAAGAGATCT
TAGGGATTATTAAATTCAGACAACCTCATTTTTTATAGATGGGGAAACAAGCACAGACTCCAA
GGGTCTCATCCAAGATCACACAGTTGCAGATGCTGGCTACAAGTCTCCTGCCTCAACCACCTG
TATTACCCCATTCAGGGTCTCAAGAAGGGTCTATAAGACACTATCCATTGTGTTTCGGGCTGA
GTCCATAGAGACAACCACAGACATGGGGGACTCTGCCCACAGGGAAGGCAAGGGCTCTGGC
CATGGAGCTGGATGGGAAGACTCTGAAGCCCGAAGACATTGAATCCTGTGCAGGGAAAGAG
CGAGGGTTTTGTGTACAACACACCTGCATACCTGGATGTGAATCTCAGCTCCACCCCTTCACCA
ACTCTGTGTGGCCTGGGCAAGCCATTCTAAGGGAACCCTCCACACTGCAACTTTCATGTCTAT
AAAATGGGAATAACCATGCATTCCTTACAGGACTTTTTTGGTGTGAGGATTAAATGAGAGAAT
ATGTTGAAAAGTGCTTGGTAAATATATTAATACTATGCATTCCCTCTTCTTTGAATGACGTGAC
CCAGGTAGTCAGGCTTCTGACCACTAGAGGGCAGCAGAAGGTACTGGAAAACTGGGCCGAG
TGAACCAGAGATTAGATGGGGTCCAGAGAGCAGGGATGAACTTACCCGTGTGGATTCTGGC
AACTC |
| 173 | ELF3 | 2375013 | GCCTCTTTGTTGCTGAATCTCTGGAATTT |
| 174 | ELF3 | 2375014 | TGACAATCATTAAACCAGCCGGGCCTGATTTCCCAGCACTGCCTGCTAAGATCCGGGCCAAGT
GGCACTGAATATGCAAATCACCTGGGGCCAGGAGCCCAGTCTAAAGGCCAGGAAATCCCCTC
CATCCAATGAGACACCAGCTCAGGTTACTGCAGGGGACACACTATAAAGCCCTGAGCTCAGG
GAGGAGCTCCCTCCAGGCTCTATTTAGAGCCGGGTAGGGGAGCGCAGCGGCCAGATACCTCA
GCGCTACCTGGCGGAACTGGATTTCTC |
| 175 | ELF3 | 2375015 | GGGTCCAGAGGATTTGCAGTTCTGAACCTGCACACTCCAGTCTAGGATCTCCGAGCAAGAGC |
| 176 | ELF3 | 2375016 | GAATGGCCATGACGCCGCTAGTCTGGCTCCAGGGCCCCAGAGATCTGAGGAGGGAAGCCCA
GCTGGAGGCTCCTGTGGTCCTGCCCTGGTCTGAGATCTTGGAGCCCTTCTTGAAGAGACGGT
GTCCGCAGAGTTGCTGATCTTCCTGCCCCTGGGGCTACTCTTGCCCAGGGTTGGGCAA |
| 177 | ELF3 | 2375017 | GCTGCAACCTGTGAGATTAGCAACATTTTTAGCAACTACTTCAGTGCGATGTACAGCTCGGAG
GACTCCACCCTGGCCTCTGTTCCCCCTGCTGCCACCTTTGGGGCCGATGACTTGGTACTGACCC
TGA |
| 178 | ELF3 | 2375018 | TCTAAGGGCCTGTTAGACAAATGGGGGAATAGGCAGGGAGGAGGGTCTCTAGGCAAATTCC
AGGGCTAGAGGCTGAGACTTAGTGACTGAGGTGCTGGGGGTTGTGGGCTGTGACAGGCAG
AGGGAGGTGTCAGATACCAGGACAAGGGTGTTGTGAATGCTACCTCC |
| 179 | ELF3 | 2375020 | CAGTTCTGGTCGAAGACGCAGGTTCTGGACTGGATCAGCTACCAAGTGGAGAAGAACAAGTA
CGACGCAAGCGCCATTGACTTCTCACGATGTGACATGGATGGCGCCACCCTCTGCAATTGTGC
CCTTGAG |
| 180 | ELF3 | 2375021 | CCACATGTTGAGCTGAGTCGAGTTCAGTGTGGCCGTAGGCAG |
| 181 | ELF3 | 2375022 | TTCCAGCTCTTCTGATGAGCTCAGTTGGATCATTGAGCTGCTGGA |
| 182 | ELF3 | 2375023 | CCCTCCACAGAGTGCTAGAGATGACCCCCTCCCCAGACTTCTTCCTCCCTCAATTAGAAA |
| 183 | ELF3 | 2375024 | GGGCAGCCCCTTTGCCCAGGAGCTGCTGGA |
| 184 | ELF3 | 2375025 | GCAGCTGTGGCGCAGGAGCCCCCTCC |
| 185 | ELF3 | 2375026 | TGAGAGCCAGCAGCGTGGTTGAGCAGAGGGTGGGCCGGCAGGGGACTTACTCTGACCCCGC |
| 186 | ELF3 | 2375027 | TGGTGCTTCTCGGAGCTCCCACTCCTCAGACTCCGGTGGAAGTGACGTGGACCTGGATCCCAC
TGATGGCAAGCTC |
| 187 | ELF3 | 2375028 | ATGGTTTTCGTGACTGCAAGAAGGGGGATCCCAAGCACGGGAAGCGGAAACGAGGCCGGCC
CCGAAAGCTGAGCAAAGAGTACTGGGACTGTCTCGAGGGCAAGAAGAGCA |
| 188 | ELF3 | 2375030 | AGAGGGGACACCTGGATGGCAAACTGATGGAGGCT |
| 189 | ELF3 | 2375031 | CCCACCTGTGGGAGTTCATCCGGGACATCCTCATCCACCCGGAGCTCAACGAGGGCCTCATGA
AGTGGGAGAATCGGCATGAAGGCGTCTTC |
| 190 | ELF3 | 2375033 | GTACTACTACAAACGGGAGATCCTGGAACGGGTGGATGGCCGGCGACTCGTCTACAAGTTTG
GCAAAAACTCAAGCGGCTGGAAGGAGGAAGAGGTTCTCCAGAGTCGGAACTGA |
| 191 | ELF3 | 2375034 | TCACGGACCACTCGAGGCCTGCAAACCTTCCTGGGAGGACAGGCAGGCCAGATGGCCCCTCC
ACTGGGAATGCTCCCAGCTGTGCTGTGGAGAGAAGCTGATGTTTTGGTGTATTGTCAGCCA
TCGTCCTGGGACTCGGAGACTATGGCCTCGCCTCCCCACCCTCCTCTTGGAATTACAAGCCCTG
GGGTTTGAAGCTGACTTTATAGCTGCAAGTGTATCTCCTTTTATCTGGTGCCTCCTCAAACCCA
GTCTCAGACACTAAATGCAGACAACACCTTCCTCCTGCAGACACCTGGACTGAGCCAAGGAG |

TABLE 13-continued

Subtyping Target Sequences

| SEQ ID NO. | Gene | Affy Probeset ID | Sequence |
|---|---|---|---|
| | | | GCCTGGGGAGGCCCTAGGGGAGCACCGTGATGGAGAGGACAGAGCAGGGGCTCCAGCACC TTCTTTCTGGACTGGCGTTCACCTC |
| 192 | ELF3 | 2375035 | GAAATTTGGGCCTTTGGATCGAATATGGTCAAGAGGTTGG |
| 193 | ELF3 | 2375036 | TGCTGTCATGACACCGCTCGAGTGACCTTGACCTTGACCAAGTCTGTCCTGTTTAGGACTGATT TTTCCTATTAGGCTAGGGTTTGGACCTGATGTTCTCAAGATGTCTAGAATTGCATGGCTGGCC TTGTGGAATAGATGGTTTTGCATTCCAGCCAAGTGTGCTGTAAACTGTATATCTGTAATATGA ATCCCAGCTTTTGAGTCTGACAAAATCAGAGTTAGGATCTTGTAAAGGAAAAAAAAAAAAAA ACAAAACAAAATGGAGATGAGTACTTGCTGAGAAAGAATGAGGGAAGGAGTTGGCATTTGT TGAAAGTGTAGTCTTTTTCTCTTTTTTTTTAATTGCAACTTTTACTTTAGATTTAGGAGGTCGT GCGCAGGTTTGTTACATGGGTATATTGTGTGATGCTGAGCTTGGGATGCGAATGATCCTGTCA CCCAGGTAGTGAGTATAGCACCCAGTGAAACTGTAGTCTCATGCCAGGCACTGTGCTAGCCC ACTCTGGCTCATTTAATCCTCTCCTAAGAAGAGAGGAGACACAGCGTCCCCATTTGACAGATG CAGAAAGAGGTTCCACAGGTGTGCCTTGATTCGTCCTAAAACCGTTTCCCGGAAGCTTTTCCT GGTGTGGGCGCTTCTAACCTAATCCTC |
| 194 | ELF3 | 2375037 | TGGAAATACCAATCAGATTGTTGGCTGAAGTGATGTG |
| 195 | BTG2 | 2375665 | CAGGGTAACGCTGTCTTGTGGACCCGCACTTCCCACCCGAGACCTCTCACTGAGCCCGAGCCGC |
| 196 | BTG2 | 2375666 | GGGAACCGACATGCTCCCGGAGATCGCCGCCGCCGTGGGCTTCCTCTCCAGCCTCCTGAGGA CCCGGGGCTGCGTGAGCGAGCAGAGGCTTAAGGTCTTCAGCGGGGCGCTCCA |
| 197 | BTG2 | 2375671 | CCCTATGAGGTGTCCTACCGCATTGGGGAGGACGGCTCCATCTGCGTCTTGTACGAGGAGGC CCCACTGGCCGCCTCCTGTGGGCTCCTCACCTGCAAGAACCAAGTGCTGCTGGGCCGGAGCA GCCCCTCCAAGAACTACGTGATGGCAGTCTCCAGCTA |
| 198 | BTG2 | 2375672 | CGTGCTCATGCTGCCGTGACAACAGGCCACCACATACCTCAACCTGGGGAACTGTATTTTTAA ATGAAGAGCTATTTATATATATTATTTTTTTTAAGAAAGGAGGAAAAGAAACCAAAAGTTTTT TTTAAGAAAAAAAATCCTTCAAGGGAGCTGCTTGGAAGTGGCCTCCCCAGGTGCCTTTGGAG AGAACTGTTGCGTGCTTGAGTCTGTGA |
| 199 | BTG2 | 2375673 | AGGGGCCTGTAGATGTTGCTTTCCAGCCAGGAATCTAAAGCTTTGGGTTTTCTGAGGGGGGG GAGGAGGGAACTGGAGGTTATTGGGGTTAGGATGGAAGGGAACTCTGCACAAAACCTTTGC TTTGCTAGTGCTGCTTTGTGTGTATGTGTGGCAAATAATTTGGGGGTGATTTGCAATGAAATT TTGGGACCCAAAGAGTATCCACTGGGGATGTTTTTTGGCCAAAACTCTTCCTTTTGGAACCAC ATGAAAGTCTTGATGCTGCTGCCATGATCCCTTTGAGAGGTGGCTCAAAAGCTACAGGGAAC TCCAGGTCCTTTATTACTGCCTTCTTTTCAAAAGCACAACTCTCCTCTAACCCTCCCCTCCCCCTT CCCTTCTGGTCGGGTCATAGAGCTACCGTATTTTCTAGGACAAGAGTTCTCAGTCACTGTGCA ATATGCCCCCTGGGTCCCAGGAGGGTCTGGAGGAAAACTGGCTATCAGAACCTCCTGATGCC CTGGTGGGCTTAGGGAACCATCTCTCCTGCTCTCCTTGGGATGATGGCTGGCTAGTCAGCCTT GCATGTATTCCTTGGCTGAATGGGAGAGTGCCCCATGTTCTGCAAGACTACTTGGTATTCTTG TAGGGCCGACACTA |
| 200 | BTG2 | 2375674 | CCCTGCCTTTTTAGAAGCAGCCTCATGGTCTCATGCTTAATCTTGTCTCTCTTCTCTTCTTTATGA TGTTCACTTTAAAAACAACAAAACCCCTGAGCTGGACTGTTGAGCAGGCCTGTCTCTCCTATTA AGTA |
| 201 | BTG2 | 2375675 | GGTTACTAATTGTATGATAGTGTTTTTATATGGAAGAATGTACAGCTTATGGACAAATGTACA CCTTTTTGTTA |
| 202 | G0S2 | 2378073 | GTCATTCCCGCCTCCGAGAGCCCAG |
| 203 | G0S2 | 2378074 | TGCTGGCCCTCTTCGGCGTGGTGCTCGGCCTGATGGAGACTGTGTGCAGCCCCTTCACGGCC GCCAGACGTCTGCGGGACCAGGAGGCAGCCGTGGCGGAGCTGCAGGCCGCCCTGGAGCGA CAGGCTCTCCAGAAGCAAGCCCTGCAGGAGAAAGGCAAGCAGCAGGACACGGTCCTCGGCG GCCGGGCCCTGTCCAACCGGCAGCACGCCTCCTA |
| 204 | G0S2 | 2378075 | CAGGAGCCTGACTCCGCTGGGAGAGTGCAGGAGCACGTGCTGTTTTTATTTGGACTTAACTT CAGAGAAACCGCTGACATCTAGAACTGACCTACCACAAGCATCCACCAAAGGAGTTTG |
| 205 | G0S2 | 2378076 | GCTGTGCAGCACTGCATTGTCATGACATTTCCAACACTGTGTGAATTATCTAAATGCGTCTACC ATTTTGCACTAGGGAGGAAGGATAAATGCTTTTTATGTTATTATTATTAATTATTACAATGACC ACCA |
| 206 | ENO1 | 2386864 | GGCAGCAAGGCTAAGTTTGCCGGCAGGAACTTCAGAAA |
| 207 | SCCPDH | 2389792 | CTGCAGAACAAACCGCCGCACGGAATTAGGGGCCGCCGTCCGCGCCTGCCAGGCTTGGAAG CGGACTCGCCCCCAGGGCCACCGCCCTAGGAAACCTCCCGTCGGAAGCCTCCCAAGCAAGCC GCTCACCCGCGCTCCCGCGCGAGGCGGCGTGGGCGTGGGCGCGGCCCTGCGCGGCGGC GCGCGCGGGGTGAAGGGAGCCCGGCGCGCTGGCTGCGGCGACGGCGGCCGTTGCTGCGCC GGGTACTGGGGTCGCTGCCTGAGGCGCAG |

TABLE 13-continued

Subtyping Target Sequences

| SEQ ID NO. | Gene | Affy Probeset ID | Sequence |
| --- | --- | --- | --- |
| 208 | SCCPDH | 2389793 | CCGGGGCCTGGGCTCGCTGTGGACTCGT |
| 209 | SCCPDH | 2389794 | GGCGACCGAGCAGAGGCCTTTCCACCTGGTGGTGTTCGGCGCGTCTGGCTTCACCGGCCAGT TCGTGACCGAGGAGGTGGCCCGGGAGCAGGTGGACCCGGAGCGGAGCTCCCGCCTGCC |
| 210 | SCCPDH | 2389802 | CAAAGGGGTTTATATCATTGGAAGCAGCGGCTTTGACTCCATTCCAGCAGATCTGGGAGTAAT ATATACCAGAAATA |
| 211 | SCCPDH | 2389807 | GGGTTGAGCATTCATGATGGTACCTGGAAGTCAGCAATTTATGGTTTTGGAGATCAGAGTAA TTTGAGAAAACTAAGAAATGTATCAAATCTGAAACCTGTCCCGCTCATTGG |
| 212 | SCCPDH | 2389809 | GCCAATTTCTTATTGTCGGGAACTCAAAGGTTATTCCATTCCTTTTATGGGATCTGATGTGTCT GTTGTAAGGAGGACTCAACGTTACTTGTATGAAAATTTAGAGGAATCACC |
| 213 | SCCPDH | 2389810 | GTTCAGTATGCTGCGTATGTAACTGTGGGAGGCATCACCTCTGTTATTAAGCTGATGTTTGCA GGACTTTTCTTT |
| 214 | SCCPDH | 2389811 | CCCATGGTTCTTCTCCTTTGGCTATTTTTCAAAACA |
| 215 | SCCPDH | 2389812 | GATGCTGCCTCATTCACGCTGACATTCTTT |
| 216 | SCCPDH | 2389813 | TACAGATAAGAACAAACCAAATATCAAAATTTG |
| 217 | SCCPDH | 2389814 | GTGGCTACCCCCATAGCTATGGTTCAGGCAGCCATGACTCTTCTAAGT |
| 218 | SCCPDH | 2389816 | AAAACAAAGTTGATTGACAGACTCAACAAACACGGTATTGAGTTTAGTGTTATTAGCAGCTCT GA |
| 219 | SCCPDH | 2389817 | CTGAAGTCATAACGTGCGTGAATTAACAGCTTCTCTATTTGATATTTGAAATTCTTCTGTAAGC CTGTCTGAGTGTATGTGGAAACGATTGTCAAATCTAAAATA |
| 220 | SCCPDH | 2389818 | TTTCACGAATGAGCTGGCAGGTCTAATGGGGGAGGCGGCGTCCCAGTCTGTGTTGCAGCAGC ATTCTCATCGGGGGTGCGCACACCATCGTTACTGTCGGGCAGTAACTGCCGCTTGCCTTGCCG CAGTAGGAGGGAA |
| 221 | SCCPDH | 2389819 | ATCTACACTGATTTTGGACTGTTACC |
| 222 | SCCPDH | 2389820 | GGTTTAATGTTTGGACCTGCCGATGTATTTGTATAG |
| 223 | SCCPDH | 2389821 | GTAGAAACATGCTGCTTAAGTGGCCTAACCTGTTTCTTGCCAATAAGTAGGCTTATCATTTTAT CTTTACGTAATTCTATATCTGTGACTAGGTTTTTAAGGATACAGCTTATAAGTTGCTATCA |
| 224 | ENO1 | 2395498 | CAGTCGTGTAATTGGCCCAAGTCAT |
| 225 | ENO1 | 2395499 | CCTTCGGTCACCTGTTGGCTACACAGACCCCTCCCCTCGTGTCAGCTCAGGCAGCTCGAGGCC CCCGACCAACACTTGCAGGGGTCCCTGCTAGTTAGCGCCCCACCGCCGTGGAG |
| 226 | ENO1 | 2395500 | GGCAGCAAGGCTAAGTTTGCCGGCAGGAACTTCAGAAA |
| 227 | ENO1 | 2395502 | ACTGGTGCCCCTTGCCGATCTGAGCGCTTGGCCAAGTACA |
| 228 | ENO1 | 2395503 | AATGGTTGGGGCGTCATGGTGTCTCATCGTTCGGGGGAGACTGAAGATACCTTCATCGCTGA CCTGGTTG |
| 229 | ENO1 | 2395504 | CCAACCCAAAGAGGATCGCCAAGGCCGTGAACGAGAAGTCCTGCAACTGCCTCCTGCTCAAA GTCAACCAGATTGGCTCCGTGACCGAGTC |
| 230 | ENO1 | 2395505 | CACTGATAAGGTGGTCATCGGCATGGACGTAGCGGCCTCCGAGTTCTTCAGGTCTGGGAAGT ATGACCTGGACTTCAAGTCTCCCGATGACCCCAGCAGGTACATCTCGCCTGACCAGCTGGC |
| 231 | ENO1 | 2395506 | TCCTCCCAGTCGGTGCAGCAAACTTC |
| 232 | ENO1 | 2395508 | TGCCATGCTTCTCTGCTCTGCTCTCCCCAG |
| 233 | ENO1 | 2395510 | TAAGTTTGGTGCGAACGCCATTCTGGGGGTGTCCCTTGCCGTCTGCAAAGCTGGTGCCGTTGA GAAGGGGGTCCCCCTGTACCGCCACATCGCTGACTTGGCTGGCAACTCTGAAGTCATCCTG |
| 234 | ENO1 | 2395516 | CAGGGGCTTTCCTGTTTATGGAAGAGCTTATTCTGAGAGCTGTAGAAGCCTATTGGATTCCCT GTCACGCACGAGAACAATCCATGCATGACATAATTCTAACCTGCCCGCTGCCTCACCCCACTTT TGGGAGCAGATGGAATTGCATCAGAAGAATGAGACACTTCGAGCCCTGAGGTTTCTTCCCCC CTGCAACTCTCTGGACCTTTGAAGAA |
| 235 | ENO1 | 2395518 | CAATAAAACTATTGCGCCTGCCCTGGTTAGCA |

TABLE 13-continued

Subtyping Target Sequences

| SEQ ID NO. | Gene | Affy Probeset ID | Sequence |
|---|---|---|---|
| 236 | ENO1 | 2395519 | CCTTTAGTCTGCAGTTGGCGTTTCCAGTGCATGGTCTTGCAAACTAACCTCCAGTCAGATCGTT<br>CTGAGCCAGCTGCTGTTTTGTGTGGCTCTAACCCTCTGGGGTCCTAGGTAGGAGCACTCAGAC<br>TGGGCCGGAAAGTCCTCCGATTCTGGGGGGAAAGGGGAGAGGGGGAAGAGGTCCCACAGA<br>AGGTCCCTTGGTGGGCTTCCGCGTCGGCCTCAACAGTGGTTCTCTCTAACAATGTGCTCAAG<br>CCTGTTTTAAAGTTA |
| 237 | ENO1 | 2395520 | GCGTCTCCAGACCCATTAAGTATATT |
| 238 | ENO1 | 2395522 | GCCCAGTGGTGCTTCAACTGGTATCTATGAGG |
| 239 | ENO1 | 2395524 | ATGTCTATTCTCAAGATCCATGCCAGGGAGATCTTTGACTCTCGCGGGAATCCCACTGTTGAG<br>GTTGATCTC |
| 240 | ENO1 | 2395526 | TCAACGACTCGACGCCAACGGGGTCTCTCGGATCGCGGCGCGAGGCAGGAGGGGCGGGGC<br>AGGAGGGCCGCGGCAGGCCCGGGCCGCCAAAGTTGTCAGCAAGGTCGAGGGCCGGACGTG<br>GGGCCCCAGAGCGACGCTGAGTGCGTGCGGGACTCGGAGTACGTGACGGAGCCCCGAGCTC<br>TCATGCCCGCCACGCCGCCCGGGCCATCCCCCGGAGCCCCGGCTCCGCACACCCCAGTTCGG<br>CTCACCGGTCCTATCTGGGGCCAGAGTTTCGCCCGCACCACTACAGGGCGCTGGGGAGTCG<br>GGGCCCCCAGATCTGCCCGCCTCAAGTCCGGGACGTCACCCCCCTTTCCACGCTACTGCA<br>GCCGTCGCAGTCCCACCCCTTTCCGGGAGGTGAGGGAATGAGTGACGGCTCTCCCGACGAAT<br>GGCGAGGCGGAGCTGAGGGGGCGTGCCCCGGAGGCGGGAAGTGGGTGGGGCTCGCCTTAG<br>CTAGGCAGGAAGTCGGCGCGGGCGGCGCGGACAGTATCTGTGGGTACCCGGAGCACGGAG<br>ATCTCGCCGGCTTTACGTTCACC |
| 241 | PAQR7 | 2402432 | CCCTGCTCACATTACTGGAGGTTTTCCGGAGGAAGCTGGGGCCCCTGGGAGTGGACACAGGG<br>TGCAGGGAGCAGTTCTTGTTTTATCTTTGCTGGGGGATGGGGTTGGGGCCTTATATACCCATAT<br>CTATATATACAAAATTTGTTTGGCAAGGGAGTGGGCGGCAGTTTTATTACTAAAGTTTTATAA<br>GTAGTTAAAATAATGTGTTTAAAATATGATAATCCCACT |
| 242 | PAQR7 | 2402433 | CAGAATGAACTGTCAAGGGAGGTGCTGGAGAGGGATTAACCTGTGCTGCCTGGGACCCTCA<br>GGGTCTTAGGTTGGGGAGTGTGAATAGGAGTTTGCAGATGGAGAATAGGAAGGGCATTCCA<br>GGCAGAGGGAAACCTGTCAGAGACCAAGAGGTGTGGAAGGAAAAGTGGGGTTGGGGCTG<br>GGTGGTCTGGATTATGGCCTGGATGCAATAAAGTAC |
| 243 | PAQR7 | 2402434 | CTTGTTGGCTAGGCTGGAGTAAAATGGTGC |
| 244 | PAQR7 | 2402435 | TCTGTGCACGACTCAACTGCCAAGGGCATCACTGGCCAATTCTTGGATTTAGGGATTGGCTAG<br>GAGTTGCTGGGGTCCACTCCTGGGCCTGCCCCAGCCTCTTGCCCAGGGAGAGGGAAAGAGTT<br>AACGGTGTGGGCCACTCCAGCTTGCCCTTCCACTGCCACTCACTGGGGTGAGGCTGGGGGTC<br>AGCTTGGTGAGGATTGGGGCTTCTAGATTGTCTAGGCAGGAGGTGAAACTTAGGCCAGAGTC<br>AGATTTGAGCTGAGCCAGGGGAGGCCTTGGCAACCTACTTCTACTCAGATTTCATTGCTGGAT<br>GCGGAAGGGTAGGCCCAAAATATATACAGGATCTTACTGTCCCTTGAAGCCCAGCCACAAG<br>TGTTGGAGCTGCAGAGAGACCCCAAAGGTAGTAGATTGTGCCAGATACAAATGGGTCCCATC<br>CAGTGCTTCATACTCCTTCAGTCACTATCCCAGACAGTGAGCCCCAGATCTCCTAGCTCTGGCT<br>TCTGTGTCCCACACGGCCTGTTCCCAGCTTCTCTCCTGGTTCCCTTGTTACGGATTCA |
| 245 | PAQR7 | 2402436 | CGCTCTTCTGGAAGCCGTACATCTATGCGGGCTACCGGCCGCTGCATCAGACCTGGCGCTTCT<br>ATTTCCGCACGCTGTTCCAGCAGCACAACGAGGCCGTGAATGTCTGGACCCACCTGCTGGCG<br>GCCCTGGTACTGCTGCTGCGGCTGGCCCTCTTTGTGGAGACCGTGGACTTCTGGGGAGACCC<br>ACACGCCCTGCCCCTCTTCATCATTGTCCTTGCCTCTTTCACCTACCTCTCCTTCAGTGCCTTGG<br>CTCACCTCCTGCAGGCCAAGTCTGAGTTCTGGCATTACAGCTTCTTCTTCCTGGACTATGTGGG<br>GGTGGCCGTGTACCAGTTTGGCAGTGCCTTGGCACACTTCTACTATGCTATCGAGCCCGCCTG<br>GCATGCCCAGGTGCAGGCTGTTTTTCTGCCCCATGGCTGCCTTTCTCGCCTGGCTTTCCTGCATT<br>GGCTCCTGCTATAACAAGTACATCCAGAAACCAGGCCTGCTGGGCCGCACATGCCAGGAGGT<br>GCCCTCCGTCCTGGCCTACGCACTGGACATTAGTC |
| 246 | PAQR7 | 2402438 | CAGTTACTCTGAATGGTCTTTGCTAAGAACAATTTAATGATTAAGTAAGGTCAGTGTCCTTGG<br>AAGTCCAAACTCTAGCCAGATTTCCCTGGTCTACACCCCTAGGGATAAGGTAAATGTTTAAGC<br>ACACAGTGAACTTCCTGAGGCCCCAAATCTAATGGAACTAGCTATTGAGGGCTAAAAGAGG<br>ATGGTTTTTTAGAAAAACTCGAAGCAAATCTCTCAGGCTGGGGATATTTCAAAGACTACTACT<br>ATTATTATTAATAACAATTGCAATATTTGTTGAGTCCCTAAATGAAGCTAAAACTTTGTTCTAAT<br>AAATTTAATCTTTACAGCAACCTATGAGGTAGATAATATTGTCATTCCCATGAGGGAGCTAAG<br>GATCAGAGAAGGTAAGTCACTTGTCTAAGGTCACATAGCTAGCATGTTATGCAATCAGGAGT<br>CAAACCTGGTTTGTCTGAATCTGAAGTCCATCTGCTCTGTGCACTTTTATACCGTCTG |
| 247 | IFI6 | 2403262 | GCTATTCACAGATGCGAACATAGTACACTGCAGCCTCCAACTCCTAGCCTCAAGTGATCCTCCT<br>GTCTCAACCTCCCAAGTAGGATTACAAGCATGCGCCGACGATGCCCAGAATCCAGAACTTTGT<br>CTATCACTCTCC |
| 248 | IFI6 | 2403263 | CTTCTTGGCCTAACTCTTCCAGTTAGG |
| 249 | IFI6 | 2403264 | GGCAGCAGCGTCGTCATAGGTAATATTGGTGCCCTGATGGGCTACGCCACCCACAAGTATCTC<br>GATAGTGAGGAGGA |

TABLE 13-continued

Subtyping Target Sequences

| SEQ ID NO. | Gene | Affy Probeset ID | Sequence |
|---|---|---|---|
| 250 | IFI6 | 2403265 | TCGCAGTCGCCGGGCTGCCCGCGCTGGGCTTCACCGGCGCCGGCATCGCGGCCAACTCGGTG<br>GCTGCCTCGCTGATGAGCTGGTCTGCGATCCTGAATGGGGGCGGCGT |
| 251 | IFI6 | 2403266 | TAAGAAAAAGTGCTCGGAGAGCTCGGACAGCGGCTCCGGGTTCTGGAAGGC |
| 252 | IFI6 | 2403269 | GTATCGCTTTTCTTGTGCTACCTGCTGCTCTTCACTTGCA |
| 253 | LAPTM5 | 2404159 | GCGACAGGGAGGAAGTTTCAATAAAGCAGC |
| 254 | LAPTM5 | 2404160 | TCACAACTGGGTCAACGCTTTAGGCTGAGTCACTCCTCGGGTCTCTCCATAATTCAGCCCAACA<br>ATGCTTGGTTTATTTCAATCAGCTCTGACACTTGTTTAGACGATTGGCCATTCTAAAGTTGGTG<br>AGTTTGTCAAGCAACTATCGACTTGATCAGTTCAGCCAAGCAACTGACAAATCAAAAACCCAC<br>TTGTCAGTTCAGTAAAATAATTTGGTCAAACAACAGTCTATTGCATTGATTTATAAATAGTTGT<br>CAGTTCACATAGCAATTTAATCAAGTAATCATTAATTAGTTACCCCCTATATATAAATATATGTA<br>ATCAATTTCTTCAAATAGCTTGCTTACATGATAATCAATTAGCCAACCATGAGTCATTTAGAAT<br>AGTGATAAATAGAATACACAGAATAGTGATGAAATTCAATTTAAAAAATCACGTTAGCCTCCA<br>AACCATTTAATTCAAATGAACCCATCAACTGGATGCCAACTCTGGCGAATGTAGGACCTCTGA<br>GTGGCTGTATAATTGTTAATTCAAATGAAATTCATTTAAACAGTTGACAAACTGTCATTCAACA<br>ATTAGCTCCAGGAAATAACAGTTATTTCATCATAAAACAGTCCCTTCAAACACACAATTGTTCT<br>GCTGAAGAGTTGTCATCAACAATCCAATGCTCACCTATTCAGTTGCTCTGTGGTCAGTGTGGC<br>TGCATAACAGTGGATTCCATGAAAGGAGTCATTTTAGTGATGAGCTGCCAGTCCATTCCCAGG<br>CCAGGCTGTCGCTGGCCATCCATTCAGTCGATTCAGTCATAGGCGAATCTGTTCTGCCCGAGG<br>CTTGTGGTCAAGCAAAAATTCAGCCCTGAAATCAGGCACATCTGTTCGTTGGACTAAACCCAC<br>AGGTTAGTTCAGTCAAAGCA |
| 255 | LAPTM5 | 2404161 | GGTGGAGCTGCCTCATAATCTGCTTTTTTGCTTTGGTGGCCCCTGTGGCCTGGGTGGGCCCTC<br>CCGCCCCTCCCTGGCAGGACAATCTGCTTGTGTC |
| 256 | LAPTM5 | 2404164 | GGCGGTGCTACAGATTGATCAAGTGCATGAACTCGGTGGAG |
| 257 | LAPTM5 | 2404167 | GCCAGGAGGATATGCCTCATAACCAGTTCATCAAGATGATGATCATCTTTTCCATCGCCTTCAT<br>CACTGTCCTTATCTTCAAG |
| 258 | LAPTM5 | 2404168 | GTTCCCCCTGATGACGCTGCAGCTGCTGGACTTCTGCCTGAGCATCCTGACCCTCTGCAGCTCC<br>TACATGGAAGTGCCCACCTATCTCAACTTCAAGTCCATGAACCACA |
| 259 | LAPTM5 | 2404169 | AAATCATGGACTATCTCCTGTGCCTGCTCACCCTGCTGGGCTCCTACATTGAGCTGCCCGCCTA<br>CCTCAAGTTGGCCTCCCGGAGCCGTGC |
| 260 | LAPTM5 | 2404170 | TCTTCATCATCAGCCTGAGCCTACTGATCGGCGTAGTCAAG |
| 261 | LAPTM5 | 2404171 | GGGCTTTCCTGTGCATCCTCATGTCCCCAAACCAGTGGTTCCCCAAGTGTGG |
| 262 | LAPTM5 | 2404183 | ACCCCCGCTTGTCCACTGTCCGCCAGACCTGCTGCTGCTTCAATGTCCGCATCGCAACCACCGCC |
| 263 | LAPTM5 | 2404184 | TGTCTCAGAGGAGGGGACGGCAGCACC |
| 264 | CYP4Z2P | 2411036 | CTATGCCTTCATACCATTCTCAGCT |
| 265 | CYP4Z2P | 2411038 | CCCTTGAGATTCTCCAGGGAAAGTTCTGAA |
| 266 | CYP4Z2P | 2411040 | CTGTGTTTATCAATATTTGGGCTCT |
| 267 | CYP4Z2P | 2411046 | ATGTGCATCAAGGAATGCCTCCGCCTCTACGCACCGGTAGTAAACATATCCCGGTTACTCGA |
| 268 | CYP4Z2P | 2411048 | GATGAAATCAGGGAACTCCTAGGGGATGGGTCTTCTATTACCTG |
| 269 | CYP4Z2P | 2411050 | TACCCTGAGCATCAGCAGAGATGCTGA |
| 270 | CYP4Z2P | 2411052 | CTGAAGTGAAAACGTTCATGTTTGCAGGACA |
| 271 | CYP4Z2P | 2411054 | TACTACTCAGAAAAGACGCCAGGATTTTCTGGACAT |
| 272 | CYP4Z2P | 2411056 | CCCTGGACTCATACCTGAAAGCAGTGTTCAACCTTAGCAAAATCTCCAACCAGCGCATGAACA<br>ATTTTCTACATCACAACGACCTGGTTTTCAAATTCAGCTCTCAAGGCCAATCTTTTCTA |
| 273 | CYP4Z2P | 2411058 | TGGGAGGAACACATTGCCCAAAACTCACGTCTGGAGCTCTTTCAACATGTCTCCCTGATGAC |
| 274 | CYP4Z2P | 2411060 | CGAGGACTTGTGACCCTGGATGGTTCTAAATGGAAAAAGCACCGCCAGATTGTGAAACCTGG<br>CTTCAACATCAGCATTCTGAAAATATTCATCACCATGATG |
| 275 | CYP4Z2P | 2411078 | CTTGTGGGTTGGACCCTTTACGATGTTCTTCA |

TABLE 13-continued

Subtyping Target Sequences

| SEQ ID NO. | Gene | Affy Probeset ID | Sequence |
|---|---|---|---|
| 276 | CYP4Z2P | 2411080 | AGGAGATGGACGATCAGAGCCATGCACCTGTTTCCTGCACCCCCTGCGCACTGGTTCTATGGC CACAAGG |
| 277 | CYP4Z2P | 2411082 | TCCTGGCTTCAGGAACTCATGGCTCACCCCTTCTTGCTGCTGATCCTCCTCTGCATGTCTCTGCT GCTGT |
| 278 | TACSTD2 | 2414960 | GACAACCCGGGATCGTTTGCAAGTAACTGAATCCATTGCGACATTGTGAAGGCTTAAATGAG TTTAGATGGGAAATAGCGTTGTTATCGCCTTGGGTTTAAATTATTTGATGAGTTCCACTTGTAT CATGGCCTACCCGAGGAGAAGAGGAGTTTGTTAACTGGGCCTATGTAGTAGCCTCATTTACCA TCGTTTGTATTACTGACCACATATGCTTGTCACTGGGAAGAAGCCTGTTTCAGCTGCCTGAAC GCAGTTTGGATGTCTTTGAGGACAGACATTGCCCGGAAACTCAGTCTATTTA |
| 279 | TACSTD2 | 2414961 | GTGAGTCACGCTTCCTGATTCCTCGGCGCAAAGGAGACGTTTATCCTTTCAAATTCCTGCCTTC CCCCTCCCTTTTGCGCACACACCAGGTTTAATAGATCCTGGCCTC |
| 280 | TACSTD2 | 2414962 | TACCGGATTTCGGTATCGTCCCAGACCCA |
| 281 | TACSTD2 | 2414963 | TCGGGGAAGTACAAGAAGGTGGAGATCAAGGAACTGGGGGAGTTGAGAAA |
| 282 | TACSTD2 | 2414964 | GTTCTCCATGAAGCGCCTCACCGCCGGCCTCATCGCCGTCATCGTGGTGGTCGTGGTGGCCCT CGTCGCCGGCATGGCCGTCCTGGTGATCACCAACCG |
| 283 | TACSTD2 | 2414965 | GTGGAGCGCACGCTCATCTATTACCTGGACGAGATTCCCCCGA |
| 284 | TACSTD2 | 2414966 | AACACGTCTCAGAAGGCCGCCGGTGACGTGGATATCGGCGATGCCGCCTACTACTTCGAGAG GGACATCAAGGGCGAGTCTCTATTCCAGGGC |
| 285 | TACSTD2 | 2414967 | CTGCACGTGTCCCACCAACAAGATGACCGTGTGCAGCCCCGACGGCCCCGGCGGCCGCTGCC AGTGCCGCGCGCTGGGCTCGGGCATGGCGGTCGACTGCTCCACGCTGACCTCCAAGTGTCTG CTGCTCAAGGCGCGCATGAGCGCCCCCAAGAACGCCCGCACGCTGGTGCGGCCGAGTGAGC ACGCGCTCGTGGACAACGATGGCCTCTACGACCCCGACTGCGACCCCGAGGGCCGCTTCAAG GCGCGCCAGTGCAACCAGACGTCGGTGTGCTGGTGCGTGAACTCGGTGGGCGTGCGCCGCA CGGACAAGGGCGACCTGAGCCTACGCTGCGATGA |
| 286 | TACSTD2 | 2414968 | CTTCCCTGTTCTGATCCTATCGCGGGCGGCGCAGGGCCGGCTTGGCCTTCCGTGGGACGGGG AGGGGGGCGGGATGTGTCACCCAAATACCAGTGGGGACGGTCGGTGGTGGAACCAGCCGG GCAGGTCGGGTAGAGTATAAGAGCCGGAGGGAGCGGCCGGGCGGCAGACGCCTGCAGACC ATCCCAGACGCCGGAGCCCGAGCCCCGACGAGTCCCCGCGCCTCATCCGCCCGCGTCCGGTC CGCGT |
| 287 | GBP1 | 2421885 | GGAAATCTCATAAGCTGGTACCACTCAGGAGAAGTTTATTCTTCCAGATGACCAGCAGTAGAC AAATGGATACTGAGCAGAGTCTTAGGTAAAAGTCTTGGGAAATATTTGGGCATTGGTCTGGC CAAGTCTACAATGTCCCAATATCAAGGACAACCACCCTAGCTTC |
| 288 | GBP1 | 2421890 | AAGCTGAGTCTGCACAGGCTTCAGCAAAAATGTTGCAGGAAATGCAAAGAAAGAATGAGCA GATGATGGAACAGAAGGAGAGGAGTTATCAGGAACACTTGAAACAACTGACTGAGAAGATG GAGAACGACAGGGTCCAGTTGCTGAAAGAGCAAGAGAGGACCCTCGCTCTTAAACTTCAG |
| 289 | GBP1 | 2421891 | GACTGGATAAACATGGGACCCTTTAACTAGAGCAAGATCCACAAAGGTGTGTCTTACTTGCCG AGGTCATCTCTGAGTAGGGCATATGCAGTCAGCAACAACGACAGGTAAGTGTA |
| 290 | GBP1 | 2421892 | TATGACTGATGCAATTCTCCAGACAG |
| 291 | GBP1 | 2421894 | TGGAAAGCTGCTGACCTGCCTCCTACAAACACCAAGGTGACCAAGCTTCACTGCATACAGATG TGCTTTTTTGTTTGCATAACATTCATGCTTTTATTCAATAACATATGCAAACAGGCTGTTATACC AGATATGTCCTAGGTGCTCATCAAAGAGAGTGCAGTCAATTAACTATTAAGTTATAAATTCAA TTAGCAGATGAAGCACAAAGTTATTATTGTCATCATTACAGCTGGGCTTTTCCTGTTGCAAGA GACAGGAACCCAATGATGGCTGCTTAAACAAAAATGTAATTCATTGATTTAGGCTGCAAACTG GCTTTACAGGTCAGGTGGGTCTAA |
| 292 | GBP1 | 2421900 | TGAAACTTTTAACCTGCCCAGACTCTGTATCCGGAAATTCTTCCCAAAGAAAAATGCTTTGTC TTTGATCGGCCCGTTCACCGCAGGAAGCTTGCCCAGCTCGAGAAACTACAAGATGAAGAGCT GGACCCCGAATTTGTGCAACAAGT |
| 293 | GBP1 | 2421902 | GGTTTGTGATCTTCTACTTAGCCATAGA |
| 294 | GBP1 | 2421903 | GAGAGCTTCAACTGATAAATGAGGATGAGAAAACACAAGAAATTATCATTTTTCAGTTTACTA TTGCTAGTTTTCCAGCATTTGCAGTTTTCTATGTCTTCAGCTGGCTATTCCTAGAAATTAATACT TGCTGAATATCCAAATTAATAGATGTTATTTAAATTACATTTGTCATTGTTCTAGAACAAGTTT CTTGTTCTTTCACCTTTGTGTATGCTGTGATTAGGTTAATTTTATCTCCCTG |
| 295 | GBP1 | 2421904 | GACACATAGAATCCGATCAAAATCCTCACCTGATGAGAATGAGAATGAGGTTGAGGATTCAG CTGACTTTGTGAGCTTCTTCCCAGACTTTGTGTGGACACTGAGAGATTTCTCCCTGGACTTGGA AGCAGATGGACAACCCCTCACACCAGATGAGTACCTGACATACTCCCTGAAGCTGAA |

TABLE 13-continued

Subtyping Target Sequences

| SEQ ID NO. | Gene | Affy Probeset ID | Sequence |
|---|---|---|---|
| 296 | GBP1 | 2421905 | ATCCCATGTATCCACTTTAGAACTGACACTGACACTTAGGTTAGGAG |
| 297 | GBP1 | 2421906 | CTGAGCAGCACCTTCGTGTACAATAGCAT |
| 298 | GBP1 | 2421907 | GTGCAGTCTCACACTAAAGGAATCTGGATGTGGTGTGTGCCCCACCCCAAGAAGCCAGGCCACATCCTAGTTCTGCTGGACACCGAGGGTC |
| 299 | GBP1 | 2421909 | AGCACAAATTATGCCTCTCCTAAAAGGAGTAA |
| 300 | GBP1 | 2421910 | ATCTACACAGTCAGCCTCCATTATG |
| 301 | GBP1 | 2421911 | GAGAACACTAATGGGCGACTGATGGCGAATCCAGAAGCTCTG |
| 302 | GBP1 | 2421912 | ATGGCATCAGAGATCCACATGACAGGCC |
| 303 | GBP1 | 2421951 | CTGAGCAGCACCTTCGTGTACAATAGCAT |
| 304 | GBP5 | 2422037 | GGCCATAGACTAGCTCTGATCTGTGGCCTCTTAGGAACCCGGCCACACAGCAGGAGGTGAGCAGCAGGTAAGTGAGCATTACAGCCTGAGCTCCACCTCCTGTCAGATCAGCAGTGACATTAGATTCTCACAGGAGTGGGAACCCTATTGTGAACTGTGCATGCAAAAGATCTAGGTTGTGTGATCCTTGTGGAACAATATAAACCAGAAACCAATAACGCCACCCCACCTCCAACCCCCGCCAACCCTCTGTGGAAAAATTACCTTCCACGAAACTGGTCCCTGATGCCAAATAGGTTGGGGGACCGCTGACCTAGAGGGAGTTATGCACATGGGCTTATAAGGTTAGCCAAGAGAAAGGACAAGAAGACCCAAAGTCGGCAAGCAAATTTATTAACCTGCTGGGCTGCTCTACAGAAATCTGAGGAGGCAGACACCCGGGCTTACAGGCTAAGGGGTATAAGTAGGTCTGCAGGGGTTTTGTGTGTGTGCGGGGGTGTCGGGGGGCAAGGCCATTTGTGGAGACTTTTCCTCCCAGTATGGCCACATCCTGCAGTTTGTCAGTTTTTGCCCCCGCCTGGCTCAGGGTACCAGGATGTGGTTTAGCTTAGGGGTGGTTATAGTGGCACCTAAGTTCTGGGAACTTGCGGTGGGGCGACCTTTTGGACGAAAATAAGCTGCAGGGCAGCTAGGGGAGGGGCTTGTTATATTCCTCTGGGGGCAGGGTGTCCCTAACTGGGTCAGTCGGAAGGAACTTGACCAAAGTCTGGGCTCAGTTGGGCATCACTCAGGCTAATGGTCG |
| 305 | GBP5 | 2422038 | AGTGCTAAATATGGGAGTTTCCTTTTTTTACTCTTTGTCACTGATGACACAACAGAAAAGAAACTGTAGACCTTGGGACAATCAACATTTAA |
| 306 | GBP5 | 2422039 | GCACAACATTCCAAGCTCAAAATAGAAGCCTTCTCAGTGAGCTCCAGCACGCCCAGAGGACTGTTAATAACGAT |
| 307 | GBP5 | 2422041 | GTATTCATCAATTGTTTCATCTCTCCCCTGCCTGTAACGATGAGAGTATGTAGCAGTGGCAAAGAGGGAGAGGCAGCAAGATCTTGTGGCTCTCAGC |
| 308 | GBP5 | 2422042 | AGCGCAAAGGTTGGCGGCGATTCAAAGGCAGAACGAGCAAATGATGCAGGAGAGGGAGAGACTCCATCAGGAACAAGTGAGACAAATG |
| 309 | GBP5 | 2422043 | CCCTCATGGGATGTTAAACTAGAGCAAGAATGGCAAAGATGCTTCTTAGCTCCTCAAGCATATCTGACTGGCATGATCCTGCATTGTGGTTACCTGGAAGGGAAAAACAACCCCTGGGAATTTTATCCAGGAAGTTGGAACAATCACAAACAAAAGTGGGA |
| 310 | GBP5 | 2422044 | TGCAATATTACAGACTGACCAGGCTCTCACAGAG |
| 311 | GBP5 | 2422045 | GTTGGTGTTCCTCGCACAGAATTTATATCTAATGGTAGCAGTGGGGTTAAACTGAACCATCACCATAATCACCAGACTTGCTTTGTGACCATCAACATTCATTGCAACAAAGAGGCCTTTTTGGTTACATTGGACAGAATGCCAATACTTGAAACTAACCTAAGAAACACCAGTAATTCATTGGCTTACACAAACTAAAAGCAAAGATTTTAATTTAGTTTCAAGTATAGATGCATTCAGAATTTTAAACAATATTATCCCTTTTCCTCCTTCTTTCTGTCATTTTTCTGTTTCATTTTCCTGACTATTGGCTTCATTTCCAGGCAGGCTCACCCCACATGACAATAAAGGTGACACCAACAGGTCCAAGCTTAACTAGTCCTTACTGCCCTCAGTCTCAGGGGAAAGAGAGCATCTTTTCTCCAGCATATATCTGTCATTCAAACACAAAAGCATCATCAATTTTCATACTCTTTGCAGTATTTTTCTCCCTGTGAACAAGTCCTTTGCATCTAGTGGACTTGCATGCTCTGACTGACCATGAGTCATGGCCAAACTTGTGACAGGAGCAGGTGTTCCACAAGCCTCTCCAGTCTCAATTGGCAGTTCCACCAAGTGCAGGGTGGAAGCCTGTATAGGCTCCACCTCTCCTATGGCAAGCCTCTCCTATGAGGAATAGATGCTGCTGGAAGGAACAAGACAAAGATGTTTACAACATTCCTAATCACCATTTCCTGCATCTAACTGCATGTTTTCCGGGTTGCTA |
| 312 | GBP5 | 2422046 | GGAACCTGGAAGCATCCTCGGATTATTGCTCGGCTTTACTTAAGGATATTTTTGGTCCTCTAGAAGAAGCAGTGAAGCAGGGAATTTATTCTAAGCCAGGAGGCCATAATCTCTTCATTCAGAAAACAGAAGAACTGAAGGCAAAGTACTATCGGGAGCCTCGGA |
| 313 | GBP5 | 2422049 | GCCTTGCATAGAGAATGCAGTCCTGGCCTTGGCTCAGAGAGAGAACTCAGCTGCAGTCAAAAGGCCATTGCCCACTATGACCAGCAAATGGGCCAGAAAGTGCAGCTGCCCATGGAAACCCTCCAGGAGCTGCTGGACCTGCACAGGACCAGTGAGAGGGAGGCCATTGAAGTCTTCATGAAAAACTCTTTCAAGGATGTAGACCAAAGTTTCCAGA |
| 314 | GBP5 | 2422050 | TGTTCCTACATCTTTAGCCATTCTATGACCAAGACTCTTCCAGGTGGCATCATGGTC |

TABLE 13-continued

Subtyping Target Sequences

| SEQ ID NO. | Gene | Affy Probeset ID | Sequence |
|---|---|---|---|
| 315 | GBP5 | 2422051 | TGATGAGCTAGAGCCTGAATTTGTGCAACAAGTG |
| 316 | GBP5 | 2422052 | AAATGCTTTATCTTTGACTTACCTGCTCACCAA |
| 317 | GBP5 | 2422053 | TCAAAATTTCAATTTGCCCCGTCTGTGTATACAG |
| 318 | GBP5 | 2422055 | CTGGAAATAGATGGGCAACTTGTCAC |
| 319 | GBP5 | 2422056 | ACTGACAGATCTGCTCAAGGCAAGAAACTCACCCGACCTTGACAGGGTTGAAGATCC |
| 320 | GBP5 | 2422058 | GATCTTTGCACTGGCACTCTTACTGAGCAGCACCTTTGTGTACAATACTGTGAACAAAATTGATCAGGGTGCTATCGACCTACTGCA |
| 321 | GBP5 | 2422059 | CTCTGTTGCATCTACGGTGCAGTCTCACACCAAGGGAATTTGGATATGGTGTGTGCCTCATCCCAACTGGCCAAATCACACATTAGTTCTGCTTGACACCGAGGGC |
| 322 | GBP5 | 2422062 | TCTGCCATTACGCAACCTGTAGTTGTGGTAGCGATTGTGGGCCTC |
| 323 | GBP5 | 2422063 | TGGCTTTAGAGATCCACATGTCAGACCCCATGTGCCTCATCGAGAACTTTAATGAGCAGCTGAAG |
| 324 | GBP5 | 2422064 | GGGTCAGGCTTGCACTAGGCATTTCCTGACTCCCATGTCCTAGTGCTACACCATTTGCAAATGGATATCCTATTTTCTGCTGCCAAGCAGTTTCTGTTTTAATTTATGTCAACATAATGATTTCCAGGGCATTAGCTATGAGGAAGCAGGGAGAATGGGTCTTCATAATTGTAAAATGACAGTTTTTGAAATTTGCTAGTAAAGAGATGGAGAATCCAAACCTTTTCATTGTAAGATTTTAGTGAAAGAACTCGTCAAGCGGATAGTGAAGTTTTAGCATCCTTAGTAAATAACCACCTTTAAAATGGAAGAAAACTATCCTTTATGATAAGGCAAAGTAGAAAAGCATATTTTTATGGCATTTGCTTTTTCTCATATAGCTCAAACATTTTTTTTAACCAGAGACTCTTTAGGTTATAGGGATTGATGCTCAGAAGTTAGAAAAAATAGGTTAAGTATTATTAAAGGAAGTTGTTTTACTCATTCAGTCAATCATAAAATAATCATGCTTTGAAGTTTTGGTTTAATAAAGCACATTAGTAACTATGTAAAAAATTTCAAGTATATCACTAAGAAGCAAACAGCTATGATTTGTTAGATAATGCTGCATAATGACTTGGTAGTATTTAATGTAATGCAGTTTGACTGGACATAGATCTAACTGAAAAAAATGAAGTTGACACAAAGTAAAAGGAACAGTGTAATATATTAATAAAGAACATCATAAAGAATTAATATAGGAACCCAGGGAGGTAAAAACTAAAAAACATAACTAAGCCAAAAACCAATGGAATAAGAGTTAGATTCAAACTAGTAGGTTAGACGCAGGAAATGGATTTTCGTATGCCTATCAAATATTTAAGAACCAGTAGAATGGCCTATAGTAGACATATAAAGGGCCTAGGACTTACTTTTGTTTTAAAATAAAGTCTCTCTATTTTACAGGACTCTTTTTATTTTAAAACTTTTTTTTTTCCAGAAACTTAGGCAGTGCTG |
| 325 | GBP5 | 2422065 | CTAATTGTTGTAGATCATCACTTCAAGGTGCCCATATCTTTCTAGTGGAAAAATTATTCTGGCCTCCGCTGCATACAAATCAGGCAACCAGAATTCTACATATA |
| 326 | GBP5 | 2422066 | TGCCCAACTGGATCCCTCAATACTGTCTGGCAACTGTTCACTCGTTGAAATTCTCTCCTTTGAATTTCTTACCATGACACATACTTCAAGCATTTTGTACTAGTTTGATTTCCATTTATATCCTTAATAGAGCCTTTTCCTTTTCCTTGAAATTCAAACCAGAAACTATGCAAATAAGCAAAAGCAAGCAATAACAACTACATATACAAATGCAGGCGCAAAACCCAAACTAGAATCATATGGCTGAAAACAGATGTTTTCTTTCAGAAATCCTTCCACTACCACTTCTGAGCATTTTCTCTTAGTATTTTTTTTGGGCATTTTCCTTCTTTGCACTTTTTAAAATCTCCTGCAGCTCGCTCACTCTCTTTCATAAGCCAGCAGTTATACTGATGTTAATAAATAGTTGTTTATTTACTTTTGCTTTTTTAGAAAACAAGCTGAAAGAATTGAGTGAAATGCCAGAGAGATACAGATAGCCAGTTGTAGGGCTGGGGTTGGAAATCAAGTCTAATTTAAGGCAAGGGCAAAATGTGCATTTTGTGTGTATTTTGAACCATTCTTGCATTGTTTTTATTTGCAAAGGTTATAGGGCTCAAGCAGTTAGGGAGAATGCATCCCAGAACACTAAGTTA |
| 327 | GBP5 | 2422067 | TGATAGCTATTATTTTCATGAGAAAGAACAATGAATATGATGCAAT |
| 328 | GBP5 | 2422068 | TCTACAAAGGATAGGATGCAGCTTATCCTGATGTGGTATATCAGACCTCAGTAAAGAATAAATTGTATTCTTATCAGACAGGCAGCAGAATTCATCAAGTACCAGCTGTGTCTGCC |
| 329 | F3 | 2423914 | AATATACTTTAAATAAAGGTGACTGG |
| 330 | F3 | 2423915 | GAGTAACCAGGTCGTCCAAGCAAAACAAATGGGAAAATGTCTTAAAAAATCCTGGGTGGACTTTTGAAAAGCTTTTTTTTTTTTTTTTTTTGAGACGGAGTCTTGCTCTGTTGCCCAGGCTGGAGTGCAGTAGCACGATCTCGGCTCACTGCACCCTCCGTCTCTCGGGTTCAAGCAATTGTCTGCCTCAGCCTCCCGAGTAGCTGGGATTACAGGTGCGCACTACCACGCCAAGCTAATTTTTGTATTTTTTAGTAGAGATGGGGTTTCACCATCTTGGCCAGGCTGGTCTTGAATTCCTGACCTCAGGTGATCCACCCACCTTGGCCTCCCAAAGTGCTAGTATTATGGGCGTGAACCACCATGCCCAGCCGAAAAGCTTTTGAGGGGCTGACTTCAATCCATGTAGGAAAGTAAAATGGAAGGAAATTGGGTGCATTTCTAGGACTTTTCTAACATATGTCTATAATATAGTGTTTAGGTTCTTTTTTTTTTCAGGAATACATTTTGGAAATTCAAACAATTGGCAAACTTTGTTATTAATGTGTTAAGTGCAGGAGACATTGGTATTCTGGGCACCTTCCTAATATGCTTTACA |
| 331 | F3 | 2423916 | TGGAGCTGTGGTATTTGTGGTCATCATCCTTGTCATCATCCTGGCTATATCTCTACACAAGTGT |

TABLE 13-continued

Subtyping Target Sequences

| SEQ ID NO. | Gene | Affy Probeset ID | Sequence |
|---|---|---|---|
| 332 | F3 | 2423918 | CTAATGAGTTTTTGATTGATGTGGATAAAGGAGAAAACTACTGTTTCAGTGTTCAAGCAGTGA<br>TTCCCTCCCGAACAGTTAACCGGAAGAGTACAGACAGCCCGGTAGAGTGTATGGGCCA |
| 333 | F3 | 2423919 | TTTATGACCTGTTTTAAATTGTGAATACTTGGG |
| 334 | F3 | 2423920 | CGGACAGCCAACAATTCAGAGTTTTGAACAGGTGGGAACAAAAGTGAATGTGACCGTAGAA<br>GATGAACGGACTTTAGTCAGAAGGAACAACACTTTCCTAAGCCTCCGGGATGTTTTTGGCAAG<br>GACT |
| 335 | F3 | 2423922 | AGACGTACTTGGCACGGGTCTTCTCCTACCCTGCAGGGAATGTGGAGAGCACCGGTTCTGCT<br>GGGGAGCCTCTGTATGAGAACTCCCCAGAGTT |
| 336 | F3 | 2423923 | GTGACCTCACCGACGAGATTGTGAA |
| 337 | F3 | 2423928 | CTACAAATACTGTGGCAGCATATAATTTAACTTGGAAATCAACTAATTTCAAGACAATTTTGGA<br>GTGGGAACCCAAACCCGTCAATCAAGTCTACACTGTT |
| 338 | F3 | 2423929 | TCCTGATCCAATACAGCCGACGGTGTGACAGGCCACACGTCCCCGTGGGTCTCTGTGGAAGTT<br>TCAGTGTAGCGACATTTCAGATAAAAAGTGGAAAAAGTGAAGTTTGGCTTTTTTCATTTGTATG<br>CAGTCCTAACTCTTGTCACACGTGTGGGATTTATCTTTTTCCATAACTTACTGAAAACCCTTCCT<br>GGCGGGCTGAACCTGACTCTTCCTGAGCTGAGTCCTGGACTGGCACACTGATGGCTCTGGGC<br>TCTTCCCGGTCAAGTTATAACAAGGCTTTGCCCATGAATAATTTC |
| 339 | F3 | 2423933 | CGAGACCGCCGTCGCTCGGACGCTCCTGCTCGGCTGGGTCTTCGCCCAGGT |
| 340 | F3 | 2423934 | ACGGGCGCCACGGAACCCGCTCGATCTCGCCGCCAACTGGTAGAC |
| 341 | GSTM3 | 2427209 | CCCTGGGGCTAGATCGATGATATGACCAGAAATCAAAAAGGGAATGCATTATTTATTGCTGT<br>GTAACACTGTTAAGAGAGGAGGTAGTTAAGGGATGGATAGGCACATAGAGAGGGAAGGTCT<br>CAGGAGAAGGGATAGAAAGGAACTATGTTCACAAGAACAACGGCAAGACAGTGCCTATACT<br>GCCTCTACAGTTAATAGGAAAAACGGAAGAAGTTACCCTTAAGCTAGGATGTTGCTCAGAAG<br>TGACCATCCCAACTTTGGTGCGGGCACAATAAATCAGCCTAAATGTCCCTAATTTAACCCAGCT<br>CATTATAATGTCATTAAACATGACATTAGCATTGTGGTTTTAGCACCCCATGGGTTTTGCTTA<br>GGCACTCATGGGTAATAACCAAGATGGAGTCCCTTTGGCAAAACTTAGGCATGCACAGCTGT<br>AGTACC |
| 342 | GSTM3 | 2427210 | GCCCAAATGGCAGGGATACCCAGTGATGTCAGGAGGAATAGTACAGACAGAAGGTGCTAAG<br>CAGACAATTCAACTGCCATGTTTTGCCACCCCTGTGAGCAGGGATTAGGTGTTCAGGCCAGT<br>ATCTTGGGCATGGGGGAGCCTTTGGCCAGAAGAGGTATAAAGCTC |
| 343 | GSTM3 | 2427211 | TATGCATTTCCTGCTGGTCAAGTTGTAAATTAGTATAGCTACTTTGGAGGACAATTGTAAAATT<br>TAAATCATATCCTATGACCCAGCAATTCCATGCTATAAAAACTCATCCATGGCCGGGCTTGGT<br>GGCTCACGCCTGTAATCCCAGCACTTTGGGAGGCTGAGGTGGGCAGATCACGAGGTCAAGA<br>GATCGAGACCATCCTGGCCAACATGATGAAACCCCGTTTCTACTAAAAATACAAAAATTAGCT<br>GGGCATGGTGGCATGTGCCTATAGTCCCAGCTACTCAGGAGGCTGAGGCAGGAGAATTGCTT<br>GAACCTGGGAGGCAGAGGTTGCAGTGAGCCGAGATCACGCCACTGCACTCCAGCCTGGCTAC<br>AGGGCGAGACTCTGTCTCAAAAAAAAAAAAAAAAAAAAAAAAAAACATTCAAAGAGACAT<br>ATACTAAGATGTTCACTGTGGCATTGTCTGTAATGACAAATAAGTGGAAACCGTGTAAATACC<br>TGTCAATACTATGGAGTACCATGTGGCAACGGAAGAATGAGACTGAACTGTGTGAACTAACA<br>TGCAAAGATCCCCAAAACAGGCCAGGTGTGGTTGCTCACAGCTGTAATAACAACACCTTCAGA<br>GGCTGAGGTGAGAGGATCAGTTGAGGCCAGGAGTTTAAGACCAGCCTGGGCAACATAGTGA<br>GACCCCTGTCTCCCAAAAATTTTTTTTAATTAGCTGTGCGCAATTGCTCATGCATAGTCCCAGC<br>TACCCAGGAGGCTGAGGTGGGAGGATCACTTGAGCCCAGGAATTTGAAGCTGCAGTGAGCT<br>GTGTTCTTGCCACTGCACTCCAATCTGGGTGACTGAGCAAGACCCTGTCTCTTAAAAAAATAA<br>AAAAGATCTCCAAGCATAGAGAAGAGTCTGGAGGGAAACACCAAACTCATAACAGTCTTACT<br>GCAGGCAAGTGGGATAAAGGCCCAGACTCCATGGTGGAAGTTAAAGGGCATTTCCAAGTTAA<br>GGCTAAGACTTGCTTTTCTAACTAAGAGAATGTGCTCATGCATTGCTTGTGTAGTAGAAACTA<br>GTTTTTAGAAAAGAAAGCAAACTTAAGAAACACTGACTCCTGTGGAGATGACTTGGCACCACT<br>CTCCTTTCACAGAGCAGAGTCTGAATAGTCTTCAGAGATAGGCCTGTGGGCCA |
| 344 | GSTM3 | 2427212 | TAAGGCCCAACATTAAACACAAAGCT |
| 345 | GSTM3 | 2427213 | CTGGTGTCCAGCTGAGTTTCTCTTGGGTATAAAGGCTAAAAGGGAAAAAGGATATGTGGAGA<br>ATCATCAAGATATGAATTGAATCGCTGCGATACTGGCATTTCCCTACTCCCCAACTGAGTTCAA<br>GGGCTGTAGGTTCATGCCCAAGCCCTGAGAGTGGGTACTAGAAAAAACGAGATTGCACAGTT<br>GGAGAGAGCAGGTGTGTTAAATGGGACTGGAGTCCCTGTGAAGACTGGGTGAGGATAACAC<br>AAGTAAAACTGTGGTACTGATGGACTTAACCGGAGTTC |
| 346 | GSTM3 | 2427214 | GTGGGGCAACAAGCCTGTATGCTGA |
| 347 | GSTM3 | 2427215 | GCTTTGGAGAAAATCGCTGCCTACTTACAGTCTGATCAGTTCTG |

TABLE 13-continued

Subtyping Target Sequences

| SEQ ID NO. | Gene | Affy Probeset ID | Sequence |
|---|---|---|---|
| 348 | GSTM3 | 2427216 | TGGGATCAATGGTTGGACACCTCTAGACCTTTAAGTCTTGGGAAGAGCCTAACTTCTATACCT TGGAGGCACTGTCTACAAAAAAATGGAGGAGGTAGACGCAGGCAACACGTGAATGTTGCTG TTCTGGTATGCATCTG |
| 349 | GSTM3 | 2427217 | TTCTCTTATAAAAACACTCACAGGCTCCCCTGGGACCTGCAGGATCCCATAGTGGAGGATTCT TCCCCGGCTTTTGC |
| 350 | GSTM3 | 2427218 | CCGTATATTTGACCCCAAGTGCCTGGATGAGTTCCCAAACCTGAAGGCTTTCATGTGCCGTTTT GAG |
| 351 | GSTM3 | 2427219 | GGATTTTCTCACCTATGATATCTTGGATCAG |
| 352 | GSTM3 | 2427220 | AAACTGAAGCCTCAGTACTTGGAAGAGCTACCTGGACAACTGAAACAATTCTCCATGTTTCTG GGGAAATTCTCATGGTTTGCCGGGGAAAAG |
| 353 | GSTM3 | 2427222 | ATTCGAGTGGACATCATAGAGAACCAAGTAATGGATTTCCGCACACAACTGATAAGGCTCTGT TACAGCTC |
| 354 | GSTM3 | 2427223 | CAATGCCATCTTGCGCTACATCGCTCGCAAGCACAACATGT |
| 355 | GSTM3 | 2427226 | CGCCTGCTCCTGGAGTTCACGGATACCTCTTATGAGGAGAAACGGTACACGTGCG |
| 356 | GSTM3 | 2427227 | TGAGTGCCGTCTCAACGGTAGAGCCGCTCGGTCAAAGAGACTGACGCGGAGAGGGCGGGTC TCTGGGTCCGCGATCTCCAGCAGGAGCAGCTCTACGCGGGAGCCTTTTCGAGCTGCCGAGCC ACGGATGTCGACCCCTGCCCAGCCTCTGGGATCGCGGGCCCTGTGGGGAGGGCGGAGGAG ACCACGCCGGAGCCGGGCCTAGGGGCCGCTTAACCACCGCCCCGGCAGGACGCAGGGACTC GGCAGCCCCGGGCCGGGGAACGTTAGCGGGCGGGGGTTGGGAATGGGTGGGAGCTGCGCA GTCGCTGAACCGCTGTCTT |
| 357 | GSTM3 | 2427228 | ATGTCGTGCGAGTCGTCTATGGTTCTCGGGTACTGGGATATTCGTGG |
| 358 | GSTM3 | 2427229 | AACGCCGGCATTAGTCGCGCCTGCGCACGGCCCTGTGGAGCCGCGGAGGCAAGGGACGGAG AACGGGGCGGAGGCGGAGTCAGGGCGCCCGCGCGTGGGCCCCGCCCCCTTATGTCGGGTAT AAAGCCCCTCCCGCTCACAGTTTCCCTA |
| 359 | HMGCS2 | 2431032 | CCTGCGTTTCTTGGAACCCAGAATACAAACCCAGCCTAACATGCAGCAAGCCTGCTAGACCTT GTGGGTCAGAGGGCTGGGTCCTTGCCTCACAGGCTGCCTCTGTCCCCTTGCAATTCCATTCTA TTTCTGCCACATGCCAAGTGCTATGACAGGTACAAGGCAAATAAGAACGGTAGAACACAGCT TCCCCCAGCCCACTTCCCTGTTCTAAAGACACCACATAGACAGAGAGCAGCAGACAGGGGCC AGCAGGAGCTGTAGTTCAGATCTTCTTGGTCATTCCTTGCCGCTGTTATTTGAACAAATAAACA CAGCGCAAAGGTTAACAAGTTTT |
| 360 | HMGCS2 | 2431033 | GCTTCCTGGGAAACGTATGCTAGCAGAGCTTCTCCCCGTGAATCATATTTTTAAGATCCCACTC TTAGCTGGTAAATGAATTTGAATCGACATAGTAGCCCCATAAGCATCAGCCCTGTAGAGTGAG GAGCCATCTCTAGCGGGCCCTTCATTCCTCTCCATGCTGCAATCACTGTCCTGGGCTTATGGTG CTATGGACTAGGGGTCCTTTGTGAAAGAGCAAGATGGAGCAATGGAGAGAAGACCTCTTCCT GAATCACTGGACTCCAGAAATGTGCATGCAGATCAGCTGTTGCCTTC |
| 361 | HMGCS2 | 2431035 | GTGACACAAACAGCCTTTTCCCAGGTACTTGGTACCTGGAGCGAGTGGACGAGCAGCATCGC CGAAAGTATGCCCGGCGTCC |
| 362 | HMGCS2 | 2431036 | TGGACAAGTTGGTGTCCAGCACATCAGACCTGCCAAAACGCCTAGCCTCCCGAAAGTGTGTG TCTCCTGAGGAGTTCACAGAAATAATGAACCAAAGAGAGCAATTCTACCATAAGG |
| 363 | HMGCS2 | 2431038 | TCCAGGATTGGTGCCTTCTCTTATGGCTCTGGTTTAGCAGCAAGTTTCTTTTCATTTCGAGTATC CCAGGATGCTGC |
| 364 | HMGCS2 | 2431041 | GTACGGGTGCCTGGCCTCGCTTCTGTCC |
| 365 | HMGCS2 | 2431042 | CAACAAGGACCTGGATAAAGCACTTCTAAAGGCCTCTCAGGACATGTTCGACAAGAAAACCA AGGCTTCCCTTTACCTCTCCACTCACAATGGGAACA |
| 366 | HMGCS2 | 2431044 | ACCCTTGACGATTTACAGTACATGATCTTTCATACACCCTTTTGCAAGATGGTCCAGAAGTCTC TGGCTCGCCTGATGTTCAATGACTTCCTGTCAGCCAGCAGTGACACACAAACCAGCTTATATA AGGGGCTGGA |
| 367 | HMGCS2 | 2431047 | CTACAAACCAAATTTGGCCTCGGAGTACCCAATAGTGGATGGGAAGCTTTCCATCCAGTGCTA CTTGCGGGCCTTGGATCGATGTTACACAT |
| 368 | HMGCS2 | 2431048 | GGGCATGGGACACAGATAATGACCAGAAACCTCCTTTATATGGTTCTCTCATCTTTTGTGCTCA AGGTAGGCTGCATTGTGTAGTCTCTGAAAC |
| 369 | HMGCS2 | 2431050 | GTGGCTATGCTGATTGGGCCCAAGGCCC |

TABLE 13-continued

Subtyping Target Sequences

| SEQ ID NO. | Gene | Affy Probeset ID | Sequence |
|---|---|---|---|
| 370 | HMGCS2 | 2431051 | TCTGTGGAGACATTGCCGTCTATCCCAGTGGTAATGCTCGTCCCACAG |
| 371 | HMGCS2 | 2431056 | ACCAATGCCTGCTACGGTGGTACTGCCTCCCTCTTCAATGCTGC |
| 372 | HMGCS2 | 2431057 | ACTCTTCCAGGATTCAGGCAATACTGATATTGAG |
| 373 | HMGCS2 | 2431058 | ACTTGGCCAAAGGACGTGGGCATCCTGGCCCTGGAGGTCTACTTCCCAGCCCAATATGTGGACCAAACTGACCTGGAGAAGTATAACAATGTGGAAGCAGGAAAGTATACAGTGGGCTTGGGCCAGACCCGTATGGGCTTCTGCTCAGTCCAAGAGGACATCAACTCCCTGTGCCTGACGGTGGTGCAACGGCTGATGGAGCGCATACAGCTCCCATGGGACTCTGTGGGCAGGCTGGAAGTAGGCACTGAGACCATCATTGACA |
| 374 | HMGCS2 | 2431059 | ATGCAGCGTCTGTTGACTCCAGTGAAGCGCATTCTGCAACTGACAAGAGCGGTGCAGGAAACCTCCCTCACACCTGCTCGCCTGCT |
| 375 | HMGCS2 | 2431060 | TTCTGCTGGGTTTCTGAACTGCTGGGTTTCTGCTTGCTCCTCTGGAG |
| 376 | CTSK | 2434611 | ATTTCTTCCACGATGGTGCAGTGTAACGATGCACTTTGGAAGGGAGTTGGTGTGCTATTTTGAAGCAGATGTGGTGATACTGAGATTGTCTGTTCAGTTTCCCCATTTGTTTGTGCTTCAAATGATCCTTCCTACTTTGCTTCTCTCCACCCATGACCTTTTTCACTGTGGCCATCAGGACTTTCCCTGACAGCTGTGTACTCTTAGGCTAAGAGATGTGACTACAGCCTGCCCCTGACTGTGTTGTCCCAGGGCTGATGCTGTACAGGTACAGGCTGGAGATTTTCACATAGGTTAGATTCTCATTCACGGGACTAGTTAGCTTTAAGCACCCTAGAGGACTAGGGTAATCTGACTTCTCA |
| 377 | CTSK | 2434612 | ACAAAGGATATATCCTCATGGCTCGAAATAAGAACAACGCCTGTGGCATTGCCAACC |
| 378 | CTSK | 2434614 | TGAAAGCTGCAATAGCGATAATCTGAACCATGCAGTTT |
| 379 | CTSK | 2434615 | AGAGTTGTATGTACAACCCAACAGGCAAGGCAGCTAAATGCAGAGGGTACAGAGAGATCCCCGAGGGGAATGAGAAAGCCCTGAAGAGGGCAGTGGCCCGAGTGGGACCTGTCTCTGTGGCCATTGATGCAAGCCTGACCTCCTT |
| 380 | CTSK | 2434617 | GGCTTTTAGCTCTGTGGGTGCCCTGGAGGGCAACTCAAGAAGAAAACTGGCAAACTCTTAAATCTGAGTCCCCAGAACCTAGTGGATTGTGTGTCTGAGAATGATGGCTGTGGAGGGGCTACATGACCAATGCCTTCCAATATGTGCAGAAGAACCGGGGTATTGACTCTGAAGATGCCTACCCATATGTGGGACA |
| 381 | CTSK | 2434618 | CCCTGTCTCATTCCCGCAGTAATGACACCGTTATATCCCAGAATGGGAAGGTAGAGCCCCAGACTCTGTCGACTATCGAAAGAAAGGATATGTTACTCCTGTC |
| 382 | CTSK | 2434622 | AGCTTTGCTCTGTACCCTGAGGAGATACTGGACACCCACTGGGAGCTATGGAAGAAGACCCACAGGAAGCAATATAACAACA |
| 383 | CTSK | 2434627 | AGCTGACTTCCGCAATCCCGATGGAATAAATCTAGCACCCCTGATGGTGTGCCCACACTTTGCTGCCGAAACGAAGCCAGACAACAGATT |
| 384 | S100A10 | 2435391 | GCAGAAATGAGCAGTTCGCTCCTCCCTGATAAGAGTTGTCCCAAAGGGTCGCTTAAGGAATCTGCCCCACAGCTTCCCCCATAGAAGGATTTCATGAGCAGATCAGGACACTTAGCAAATGTA |
| 385 | S100A10 | 2435392 | TCTTTTCCCTAATTGCGGGCCTCACCATTGCATGCA |
| 386 | S100A10 | 2435393 | ACCCTCTGGCTGTGGACAAAATAATGAAGGACCTGGACCAGTGTAGAGATGGCAAA |
| 387 | S100A10 | 2435400 | TGTTTACATTTCACAAATTCGCTGGGGATAAAGGCTACTTAACAAAGGAGGACCTGAGAGTACTCATGGAAAAGGA |
| 388 | S100A10 | 2435406 | CCAGACGGACCTCCTAGGGCTAATCTGATAGTGCCTCTGAGGTCGATAGGACTCCACGTGCCACTCCCTGCAGGGTCATCCAGCAAGTAATTCCTAGACCCGTAGGTGGCCGCAGAGCCGGTTACCTCTGGTTCTGCGCCAGCGTGCCCCACCCGCAGGACGGCCGGGTTCTTTGATTTGTACACTTTCTAAAACCAAACCCGAGAGGAAGGGCAGGCTCAGGGTGGGGATGCCCTGAAATATTCGAGAGCAGGACCGTTTCTACTGAAGAGA |
| 389 | SPRR2F | 2435876 | TTTCCTCTTAGCCTGTGATCGGCCTGTGATGATCTCTGATAGCAAAAGG |
| 390 | SPRR2F | 2435877 | TGCCCCGCGCCAAAGTGCCCAGAGCCAT |
| 391 | S100A8 | 2435993 | CTGAGTTACTGGGCCCAGAGGCTGGGCCCCTGGACATGT |
| 392 | S100A8 | 2435994 | AGTTGGATATCAACACTGATGGTGCAGTTAACTTCCAGGAGTTCCTCATTCTGGTGATAAAGATGGGCGTGGCAG |
| 393 | S100A8 | 2435997 | AGCCTTGAACTCTATCATCGACGTCTACCACAAGTACTCCCTGATAAAGGGGAATTTCCATGCCGTCTACAGGGATGACCTGAAGAAATTGCTAGAGACCGAGTGTCCTCAGTATATC |

TABLE 13-continued

Subtyping Target Sequences

| SEQ ID NO. | Gene | Affy Probeset ID | Sequence |
| --- | --- | --- | --- |
| 394 | S100A8 | 2435998 | ATGCAAATTCCCTGCCATGGGATTCCCCAGAAGGTTCTGT |
| 395 | S100A8 | 2435999 | TGTCTCTGTGTGAATGGACCCTTCCCCTTCCCACACGTGTATCCCTATCATCCCACCCTTCCCAC CAGAGCCATAGCCATCTGCTGGTTTGGTTATTTGGAGAGTGCAGGCCAGGACAAGGCCATCG CTTGGGGCATGAATCCTCTGCGTACTGCCCTGGC |
| 396 | S100A8 | 2436000 | ACTGTCTGGGTTGGCCCCGCACTTTGGGCTTCTCTTGGGGAGGGTCAGGGAAGTGGAGCAGC CTTCCTGAGAGAGGAGAGAGAAAGCTCAGGGAGGTCTGGAGCAAAGATACTCCTGGAGGTG GGGAGTGAGGCAGGGATAAGGAAGGAG |
| 397 | S100A8 | 2436001 | CTGGCCAAGCCTAACCGCTATAAAAAGGAGCT |
| 398 | S100A8 | 2436002 | ACTCTGGCAGGGAGAAGCTGTCTCTGATGGCCTGAAGCTGTGGGCA |
| 399 | S100A7 | 2436052 | CCCCACCAATGGGCCTCCAGAGACCCCAGGAACAATAAAATGTC |
| 400 | S100A7 | 2436053 | AAGGGCACAAATTACCTCGCCGATGTCTTTGAGAAAAAGGACAAGAATGAGGATAAGAAGA TTGATTTTTCTGAGTTTCTGTCCTTGCTGGGAGACATAGCCACAGACTACCACAAGCAGAGCC ATGGAGCAGCGCCCTGTTCCGGGGGCAG |
| 401 | S100A7 | 2436054 | GAGCAACACTCAAGCTGAGAGGTCCATAATAGGCATGATCGACATGTTTCACAAATACACCA GACGTGATGACAAGATTGAGAAGCCAAGCCTGCTGACGATGATGAAGGAGAACTTCC |
| 402 | S100A7 | 2436055 | CAGACTGACTACTGGCTGAAAGATCTGCTTTGGG |
| 403 | S100A7 | 2436056 | ACTCATCCTTCTACTCGTGACGCTTCCCAGCTCTG |
| 404 | F11R | 2440477 | GGACTCCTAGAGTGATTGGACATTCAAAATATTCCTGATAGTCTTGTTAATTAAGAGATTAGG ATATCTTTCCATTACCTTGATAATTACGTTTTAATTTAGCTTTTTTCATTGGCCTGTGTTTAAATG CAAATAACCCCACAATGGACATTTCCTATGTTAAAGTGACATTTAGGGGATAAAAAATGAGAG CAGTTCCATGGATTTTGGTGTTTCCCCTGAGACATGAACTCAGCATAATCTGGGATAAAATGA TTGAGTGTTAAGGATGTGTTTGTTGTTCCTGTCGTTTTTTATTTTCTTCAAAGTATACAACATG GTTTGATATGCACATACATTTGTGTAATGATTGCCATGGTCAATTAACACATCACCATTTTTGT GTGTGTGTGTGTGTGTGTGTGAGGGAGTCTTGCTCCGTTGCCAGGCTGGAGTGCAATGGT ACAACCTTGGCTCACTGCAACCTCCACCTCCTGGGTTCAAGCAATTCTCTTGCCTCAGCCTCCT AAGTAGCTGGGACTATAGGCGTGTGCCACCATGCCCAGCTAATTTTTGTATTTTTAGTAGAGA CGGGGTTTCACCATGTTGGCCAGGATGATCTCGATCCCTTGACCTCATGATCCGCCCACCTCG GCCTCCCAAAGTGCTGGGATTACAGGCGTGAGTCACTGCACCCGGCCACATCACCTCCCATGT TCTATCTTACGTATTCAGAACTTGTTCATCTTGTAACTGAAAGCGTGTACCCTTTGACCAACACT GTTTTTCCTGTCTTAACAGGATCTACAGATCAAGGACAGGGGAGGGGATAGTGGAGGAAAAC GGAGTTAGTCTGTTTCTAAATGAGGGGACAGTATGTTTCTTGGGGCCTGAGGACAGCTTAAT AAAGTA |
| 405 | F11R | 2440478 | GGTGATTCATGGCTCTGTGAATTTGAGGTGAATGGTTCCTTATTGTCTAGGCCACTTGTGAAG AATATGAGTCAGTTATTGCCAGCCTTGGAATTTACTTCTCTAGCTTACAATGGACCTTTTGAAC TGGAAAACACCTTGTCTGCATTC |
| 406 | F11R | 2440479 | TTCTGTGGAGGATATACTAAGTGCGACTTTGCCCTATCCTATTTGGAAATCCCTAACAGAATTG AGTTTTCTATTAAGGATCCAAAAAGAAAAACAAAATGCTAATGAAGCCATCAGTCAAGGGTC ACATGCCAATA |
| 407 | F11R | 2440480 | GGTTCCTAGGCTCCTTTGTACAACAGGAAAATGCCTCAAAGCCTTGCTTCCCAGCAACCTGGG GCTGGTTCCCAGTGCCTGGTCCTGCCCCTTCCTGGTTCTTATCTCAAGGCAGAGCTTCTGAATT TCAGGCCTTCATTCCAGAGCCCTCTTGTGGCCAGGCCTTCCTTTGCTGGAGGAAGGTACACAG GGTGAAGCTGATGCTGTACTTGGGGGATCTCCTTGGCCTGTTCCACCAAGTGAGAGAAGGTA CTTACTCTTGTACCTCCTGTTCAGCCAGGTGCATTAACAGACC |
| 408 | F11R | 2440481 | GCTGGTGGCTTAGGCCATCACCCTTCCCTTGGCTGGAACTACTGGACAGACCCTTTTGAGATG TGCCTGTGGTGCTGTGGAGATGTGTGTAGTGGTCTTAGCTCTTTGTTGAGCTTGTGTGTGTGT TGTGTAGTCTTAGCTGTATGC |
| 409 | F11R | 2440482 | GAAAAGAAAACTGGAGGCTGGGCGCAGT |
| 410 | F11R | 2440483 | CCTTGTGTACTGACGACCAGGGCCAGCTGTTCTAGAGCGGGAATTAGAGGCTAGAGCGGCTG AAATGGTTGTTTGGTGATGACACTGGGGTCCTTCCATCTCTGGGGCCCACTCTCTTCTGTCTTC CCATGGGAAGTGCCACTGGGATCCCTCTGCCCTGTCCTCCTGAATACAAGCTG |
| 411 | F11R | 2440484 | TATTTGTCTTCTACACCCCACAGGGCCCCCTACTTCTTCGGATGTGTTTTTAATAATGTCAGCTA TGTGCCCCATCCTCCTTCATGCCCTCCCTCCCTTTCCTACCACTGCTGAGTGGCCTGGAACTTGT TTAAAGTGTTTATTCCCCATTTCTTTGAGGGATCAGGAAGGAATCCTGGGTATGCCATTGACTT CCCTTCTAAGTAGACAGCAAAAAT |
| 412 | F11R | 2440485 | GCCTGGTCGGCTCACCGCCTATCATCTGCATTTGCCTTACTCAGGTGCTACCGGACTCTGGCC |

TABLE 13-continued

Subtyping Target Sequences

| SEQ ID NO. | Gene | Affy Probeset ID | Sequence |
|---|---|---|---|
| 413 | F11R | 2440486 | ATTCAAACAGACCTCGTCATTCCTGGTGTG |
| 414 | F11R | 2440490 | GTCATCGTGGCAGCCGTCCTTGTAACCCTGATTCTCCTGGGAATCTTGGTTTTTGGCATCTGGT TTGCCTATAGCCGAGGCCACTTTGACA |
| 415 | F11R | 2440491 | TTTGATCCCCTGTCAGCCTCTGATACTGGAGAATACAGCTGTGAGGCACGGAATGGGTATGG GACACCCATGACTTCAAATGCTGTGCGCATGGAAGC |
| 416 | F11R | 2440492 | CCACCATTGGGAACCGGGCAGTGCTGACATGCTCAGAACAAGATGGTTCCCCACCTTCTGAAT ACACCTGGTTCAAAGATGGGATAGTGATGCCTACGAATCCCAAAAGC |
| 417 | F11R | 2440493 | CCTTCTTGCCAACTGGTATCACCTTCAAGTCCGTGACACGGGAAGACACTGGGACATACACTT GTATGGTCTCTGAGGAAGGCGGCAACAGCTATGGGGAGGTCAAGGTCA |
| 418 | F11R | 2440494 | GAGTGGAAGTTTGACCAAGGAGACACCACCAGACTCGTTTGCTATAAT |
| 419 | F11R | 2440495 | GAAGTTGTCCTGTGCCTACTCGGGCTTTT |
| 420 | F11R | 2440496 | CCTTCGGCTCATTTTGACCCTGTCTGCAG |
| 421 | F11R | 2440497 | GGCATTGGGCAGTGTTACAGTGCACTCTTCTGAACCTG |
| 422 | F11R | 2440501 | ACAAAGGCGCAAGTCGAGAGGAAACTGTTGTGCCTCTTCATATTGGCGATCCT |
| 423 | F11R | 2440502 | TCCTTCGGCGGCTGTTGTGTCGGGAGCCTGATCGCG |
| 424 | F11R | 2440503 | TCAGTCCCCTCGCTGTAGTCGCGGAGCTGTGTCTGTTC |
| 425 | PVRL4 | 2440589 | GGAACCTGTCTCCTACCACTTCGGAGCCATGGGGCAAGTGTGAAGCAGCCAGTCCCTGGGT CAGCCAGAGGCTTGAACTGTTACAGAAGCCCTCTGCCCTCTGGTGGCCTCTGGGCCTGCTGCA TGTACATATTTTCTGTAAATATACATGCGCCGGGAGCTTCTTGCAGGAATACTGCTCCGAATCA CTTTTAATTTTTTCTTTTTTTTTCTTGCCCTTTCATTAGTTGTATTTTTTATTTATTTTTATTTTT ATTTTTTTTTAGAGATGGAGTCTCACTATGTTGCTCAGGCTGGCCTTGAACTCCTGGGCTCAAG CAATCCTCCTGCCTCAGCCTCCCTAGTAGCTGGGACTTTAAGTGTACACCACTGTGCCTGCTTT GAATCCTTTACGAAGAGAAAAAAAAAAATTAAAGAAAGCCTTTAGATTTATCCAATGTTTACTA CTGGGATTGCTTAAAGTGAGGCCCCTCCAACACCAGGGGGTTAATTCCTGTGATTGTGAAAG GGGCTACTTCCAAGGCATCTTCATGCAGGCAGCCCCTTGGGAGGGCACCTGAGAGCTGGTAG AGTCTGAAATTAGGGATGTGAGCCTCGTGGTTACTGAGTAAGGTAAAATTGCATCCACCATTG TTTGTGATACCTTAGGGAATTGCTTGGACCTGGTGACAAGGGCTCCTGTTCAATAGTGGTGTT GGGGAGAGAGAGAGCAGTGATTATAGACCGAGAGGAGTTGAGGTGAGGTGAAGGA GGTGCTGGGGGTGAGAATGTCGCCTTTCCCCCTGGGTTTTGGATCACTAATTCAAGGCTCTTC TGGATGTTTCTCTGGGTTGGGCTGGAGTTCAATGAGGTTTATTTTTAGCTGGCCCACCCAGA TACACTCAGCCAGAATACCTAGATTTAGTACCCAAACTCTTCTTAGTCTGAAATCTGCTGGATT TCTGGCCTAAGGGAGAGGCTCCCATCCTTCGTTCCCCAGCCAGCCTAGGACTTCGAATGT |
| 426 | PVRL4 | 2440590 | ACTCCACGCTGACCACGGTGAGGGAGATAGAAACACAGACTGAACTGCTGTCTCCAGGCTCT GGGCGGGCCGAGGAGGAGGAAGATCAGGATGAAGGCATCAAACAGGCCATGAACCATTTTG TTCAGGAGAATGGGACCCTACGGGCCAAGCCCACGGGCAATGGCATCTACATCAATGGGCG GGGACACC |
| 427 | PVRL4 | 2440592 | AGCCGAGGGCCACCCTGATAGTCTCAAGGACAACAGTAGCTGCTCTGTGATG |
| 428 | PVRL4 | 2440593 | GACCAGGGAGAACTCCATCCGGAGGCTGCATTCCCATCACACGGACCC |
| 429 | PVRL4 | 2440594 | TGGACCTAGTGTCAGCCTCGGTGGTGGTGGTGGGTGTGATCGCCGCACTCTTGTTCTGCCTTC TGGTGGTGGTGGTGCTCATGTCCCGATACCATCGGCGCAAGGC |
| 430 | PVRL4 | 2440596 | TGGATGGGGACACTTTGGGCTTTCCCCCACTGACCACTGAGCACAGCGGCATCTACGTCTGCC ATGTCAGCAATGAGTTCTCCTCAAGGGATTCTCAGGTCACTGT |
| 431 | PVRL4 | 2440597 | AGGCCTCTGTGAGGGGCCTTGAAGACCAAAATCTGTGGCACATTGGCAGAGAA |
| 432 | PVRL4 | 2440598 | TCCTGGTCCAGCACTAGAAGAGGGCCAGGGCCTGACCCTGGCAGCCTCCTGCACAGCTGAGG GCAGCCCAGCCCCCAGCGTGACCTGGGACACGGAGGTCAAAGGCACAACGTCCAGCCGTTCC TTCAAGCACTCCCGCTCTGCTGCCGTCACCTCAGAGTTCCACTTGGTGCCTAGCCGCAGCATG AATGGGCAGCCACTGACTTGTGTGGTGTCCATCCTGGCCTGCTCCAGGACCAAAGGATCACC CA |
| 433 | PVRL4 | 2440599 | CCTCAGACGTGGTAACTGTGGTGCTGGGCCAGGACGCAAAACTGCCCTGCTTCTACCGAGGG GACTCCGGCGAGCAAGTGGGGCAAGTGGCATGGGCTCGGTGGACGCGGGCGAAGGCGCC CAGGAACTAGCGCTACTGCACTCCAAATACGGGCTTCATGT |
| 434 | PVRL4 | 2440606 | CCCTGTCCCTGGGAGCCGAGATGTGGGGGCCTGAGGCCTGGCTGCTGCTGCTGCTACTGCTG GCATCATTTACAG |

TABLE 13-continued

Subtyping Target Sequences

| SEQ ID NO. | Gene | Affy Probeset ID | Sequence |
|---|---|---|---|
| 435 | PVRL4 | 2440607 | TCCCAGGTTTCTGCCGTCGTTGTTGGCCACAGCGTGGGAAGCAGCTCTGGGGGAGCTCGGAG<br>CTCCCGATCACGGCTTCTTGGGGGTAGCTACGGCTGGGTGTGTAGAACGGGGCCGGGGCTG<br>GGGCTGGGTCCCCTAGTGGAGACCCAAGTGCGAGAGGCAAGAACTCTGCAGCTTCCTGCCTT<br>CTGGGTCAGTTCCTTATTCAAGTCTGCAGCCGGCTCCCAGGGAGATCTCGGTGGAACT |
| 436 | FCGR3A | 2440950 | AACCATGGTAATAAAATATGAATGAT |
| 437 | FCGR3A | 2440951 | ATGCTACTCTTAGATAGAAGATGGGAA |
| 438 | FCGR3A | 2440952 | TACTAAATGTACTACTGAGCTTCGCTGAGTTAAGTTATGAAACTTTCAAATCCTTCATCATGTC<br>AGTTCCAATGAGGTGGGGATGGAGAAGACAATTGTTGCTTATGAAAGAAAGCTTTAGCTGTC<br>TCTGTTTTGTAAGCTTTAAGCGCAACATTTCTTGG |
| 439 | FCGR3A | 2440953 | TTGAGGCAGGACCATACAGAGTGTGGGAACTGCTGGGGATCTAGGGAATTCAGTGGGACCA<br>ATGAAAGCATGGCTGAGAAATAGCAGGTAGTCCAGGATAGTCTAAGGGAGGTGTTCCCATCT<br>GAGCCCAGAGATAAGGGTGTCTTCCTAGAACATTAGCCGTAGTGGAATTAACAGGAAATCAT<br>GAGGGTGACGTAGAATTGAGTCTTCCAGGGGACTCTATCAGAACTGGACCATCTCCAAGTAT<br>ATAACGATGAGTCCTCTTAATGCTAGGAGTAGAAAATGGTCCTAGGAAGGGGACTGAGGATT<br>GCGGTGGGGGGTGGGGTGGAAAAGAAAGTACAGAACAAACCCTGTGTCACTGTCCCAAGTT<br>GCTAAGTGAACAGA |
| 440 | FCGR3A | 2440954 | GGGAAAAGCCCATGATCTTCAAGCAGGGAAGCCC |
| 441 | FCGR3A | 2440955 | TCCCATGGGGGTAATAAGAGCAGTAGCAGCAGCATCTCTGAACATTTCTCTGGATTTGCAACC<br>CCATCATCCTCAGGCCTCTCTACAAGCAGCAGGAAACATAGAACTCAGAGCCAGATCCCTTAT<br>CCAACTCTCGACTTTTCCTTGGTCTC |
| 442 | FCGR3A | 2440956 | AGAGACTGGAAGGACCATAAATTTAAATGGAGAAAGGACCCTCAAGACAAATG |
| 443 | FCGR3A | 2440957 | TCATTCTTTCCACCTGGGTACCAAG |
| 444 | FCGR3A | 2440959 | TGACTTCTACATTCCAAAAGCCACACTCAAAGACAGCGGCTCCTACTTCTGCAGGGGGCTTTTTG |
| 445 | FCGR3A | 2440960 | TTCAAGGAGGAAGACCCTATTCACCTGAGGTGTCACAGCTGGAAGAACACTGCTCTGCATAA<br>GGTCACAT |
| 446 | FCGR3A | 2440961 | TAGAAACCACGAATTGCCAGGCTGAGCAATACCAGTCCCGCCCTTCCCCTCCCTGGTGTTTAC<br>ATTGAGTTCTCCTTCACAATTTCTGCAGCCACTCCGTGGCCACCGTCACCTTATTCCTGA |
| 447 | FCGR3A | 2440962 | ACTTCATTGACGCTGCCACAGTCGA |
| 448 | FCGR3A | 2440963 | CTCCCAAAGGCTGTGGTGTTCCTGGAGCCTCAATGGTACAG |
| 449 | FCGR3A | 2440965 | GCTGCTCCTCCCAACTGCTCTGCTACTTCTAG |
| 450 | FCGR3A | 2440966 | GGCTCCGGATATCTTTGGTGACTTGTCCACT |
| 451 | FCGR3A | 2440967 | GAAAGGCTGTTTACTTCCTCCTGTCTAGTCGGTTTGGTCCCT |
| 452 | PM20D1 | 2452725 | AGGGCACTCTTGCTGGGATGCTTTCTCCAGAGCTTATATATTTCTTCTTACTAGAACTTTCTTCC<br>CCCTTTTATTCCCCTCTCTTCTTGGACTCATGAGCTGTCTCTTCATCTCTCCTCTCTCTCCTGCAT<br>CTCTCCCCTTACTCTTCAATTTATTCTACTTCTGGACCTGGACTTACCCAAACTG |
| 453 | PM20D1 | 2452727 | ATGGAGACATTGTAGAACCTAACCCATCTACTGTCCTTATTGCCAGAGTCTCATTGTCACCCCC<br>TAGAATTTATGGAAATTGGCCCCTCTTTTACAAAGATGGAGATAATTGGGTGATTGGGGAGA<br>ACCTGGTGGAATCGGTACCCTTGGGTGCTAATCCCAGCTCTTCCTCTCTTTGGGAGAGGGCTT<br>ATCCTCTGGACCCCGTTTTCTCCACTTACAAAATGGGGAGACTCCTCAGCATTTTCTGAAATGC<br>AGACACATATGAGGTCAAAGGTGGATGCGTGTTTTGACTTCTCAGA |
| 454 | PM20D1 | 2452728 | AGCCGATTCTTTACAAACCTCACCACTGGCATCTACAGGTTCTACCCCATCTACATACAGCCTG<br>AAGACTTCAAA |
| 455 | PM20D1 | 2452730 | TCCATGTGTTGAGTGCCTTTGACCCCCTCCCCGTCAGCCCTTCTGATGACAAGGCCTTGGGCTA<br>CCAGCTGCTCCGCCAGACCGTACAGTCCGTCTTCCCGGAAGTCAATATTA |
| 456 | PM20D1 | 2452731 | AACTCACGAAGAACATTGTGGCTGA |
| 457 | PM20D1 | 2452734 | CCAGGCCACAGTCAACTTCCGGATTCACCCTGGACAGACAGTCCAA |
| 458 | PM20D1 | 2452736 | TCCCTTAACCAATGCAATAATCAGGACCACCACGGCACTCACCATATTCAAAGCAGGGGTCAAG |
| 459 | PM20D1 | 2452738 | GAGCAGACACCAATGCCTATCATATTTGGAAGCGGGACAGTGGTGACTGTATTGCAGCAACT<br>GGCAAATGA |

TABLE 13-continued

Subtyping Target Sequences

| SEQ ID NO. | Gene | Affy Probeset ID | Sequence |
|---|---|---|---|
| 460 | PM20D1 | 2452739 | GAGAAGGGTTCCATGAACCTCATGCTGCAAGTAAACATGACTTCAGGCCACTCTTCAG |
| 461 | PM20D1 | 2452740 | CCCTGCTACAGTCAAGGGGCGTCCAGCTAGCCTTCATTGTGGACGAGGGGGGCTTCATCTTG GATGATTTCATTCCTAACTTCAAGAAGCCC |
| 462 | PM20D1 | 2452742 | GCTGATCAGGAAGTACATCCCCCGAAGATCTTTCTTCATTT |
| 463 | PM20D1 | 2452743 | GTCAGCACCAGCTTTATCCAGCATGAAGTCGTGGAAGAGTATAGCCACCTGTTCACTATCCAA GGCTCGGACCCCAGCTTGCAGCCCTACCTGCTGATGGCTCACTTTGATGTGGTGCCTGCCCCT GAAGAAGGCTGGGAGGTGCCCCCATTCTCTGGGTTGGAGCGTGATGGCATCATCTATGGTCG GGGCACACTGGACGACAAGAACTC |
| 464 | PM20D1 | 2452744 | GCCATCCAGATTCCAACAGTGACTTTTAGCTCTGAGAAGTCCAATACTACAGCCCTGGCTGAG TTCGGAAAATACATTCA |
| 465 | PM20D1 | 2452748 | GGTGGCTATGCTGCTCCTAGTTTTCCCTACCGTCTCCAGATCGATGGGCCCGAGGAGCGGGG AGCATCAAAGGGCGTCGCGAATCCCTTCTCAGTTCAGCAAAGAGGAACGCGTC |
| 466 | PM20D1 | 2452749 | AGGTCAGAACTACCCCGGTAGCCTGACAGCAGGAG |
| 467 | GRHL1 | 2469161 | CAAACGGCCAGTGTTGGTTCTTCAG |
| 468 | GRHL1 | 2469162 | TGGAAAACCCTCTCACTGCAGCGACCAAAGCGATGATGAGCATCAATGGAGATGAAGAC |
| 469 | GRHL1 | 2469165 | AGAGAAGGTCATCAACAGCAAAGCC |
| 470 | GRHL1 | 2469166 | TTTGCCTCTGTTGCTCTGAAATTTCCTTTTTCTTTGGGCGTAGTAGTTGCCTTTTCTAGGATGA AGCACTAACATTCTCCTCCTCCAAAGGGATAGTTTTAGTAATAACTTCAGTATTTGCTTATTT GTTTTTGAGGTTTTCTTTAGAAGGATGTGTGGCAGTGGTCTATTAAAAAAATTAAGCACCAGT GACTCTTGAACAACTGCCTGAGTAAAATTGAATAAAGCAAGTTAAATTGTATTCAAATTCCTG TTGAAATTATTTGTGAAATATTTTAGATTAAAACTTTCAGAAAATTTAATTAACGTTTGGCTAG CCATGAAAAACTTTAAAAAGACACCTTTTAAATTGTCTTGTGTTTTATTATCAATCAAGGAATG AAACATATTTAAAGGAAGAATGATCATCACCCAGTATCCCATTATCGTGATGATTGCTTTATTC ATTGTTTTGATGTGTATGCAAATTTTATGTAGCGTAGTTGTGTTCACAGATAGGATTGGTAGT GTACTTTCTTCTACTTAGTTTGTTTCATAAACATTTTCTCTGTATTTTAATCTTCATAATTATCCTT TGGAAGAGGACTTGTGGCTTTTATCTTTTACTTTTCATTATGGGCATTTTCAAACATAATAAAA ATAGAAAAACAGTATAAGCCCACATGTATCCATGACCAGCCTCAACAGTTATCAACACAATTC CTCTTGTTTGATTTGTTCTTCCCTCTTCTTCAACTTTGAGATTAATTCATGTTTTTATTTTATTTAT TTTTGCTGGAACATTCTGAAGCAAACTGTAAATATCCTTACAATTGCTGCTATATCTAGTTTTCA CTATTAAGAAGTCTTAAGGAACAACTTTCTAGACTTTTTCCGTTTTAGGATAAATTCCTGGGAG TGAATTTATGGTTCAGGGTCAAACAGTTTTATTGATCTTGAAATGTACAGAATTCTCAATTTG CCTGTTTCTTGAAGCTTCAGCCTATATGATTTCTGGGGGCTTTGAAAATTCATTCATTTTACCCA CTGGAAATCATCTTGTATTGCTCAAATTATTTATCAAACCAAAATTTAATTTTATAAAAAGCAG ATGTGTCTACTGATGCAATGTAACAATAGGTTTTCTTGGGTGAAAGAGAAAGCCAGGCCCGG CACAGTGGCTCATGCCTGTAATCGCAGCGCTTTGGGAGGCTGAGGCAGGTGGATCACCTGAG GTCAGGAGTTCGAGACCAGCCTGGCCAACATGGTAAAACCCAGTCTCTACTAAAAATACAAA AATTAGCCAAGTGTGGTGGCGTGCGCCTGTAATCCCAGCTACTCGGGAGGCTGAGGTGGGA GAATCGCTTGAACCCGGGAGGCGGAGGTTGCAGTGAGCCTAGATCACGCCATTGCACACCAG CCTGGGCCATAAGGGCAAGACTCTGTCTCAAAAAAATAAAAATTAAAAAAAAAAAAAGGAG AAAGCCAAATGGCATAGGTGGTAGGAAAAGTGGTGACCAAGTAATAATAGCTCATACTTCTT GAAGACTGTGTGTCAGGCATTATTATACACCTTTTAGTGTATCATCTCATCTCAACCTGATGAG AATGGATGCCATTATTGTCCCCATTTTGCAGATGAGGATTCAGTTACTAAGAGATGAAGTAAC TTGCTCAGGTGACACAGAACTTGAACCCAGGCAATTTGACCCTGGCGTCTATGCTGTAACCCC AGTTGATCAGATCGCATAGCTTCAGGTTTCTAGTAAAACACAGTAATTGTTTTTAGGATTATG GAAAGTAAAGCTTGTTAGAGGAGAGCTCTGAGCCCTTAGTATTTCGAATGAAATTTTACTTAA TAGGTTTGGATTTTATTTGACCGATAACCAGAAAGCCTTTTTCCCTTTATCTAGTAATGGGTAG TTTTGATGTTTTCTGTTTATTCTGTCAAGTGTTATTGCACAGGACCCAA |
| 471 | GRHL1 | 2469167 | AAACAGCATACCAATTGTGACAGAGCAGCCCTCATCTCTGCTGGAGAAAACAGAGTGCAAG TACTGAAAAATGTGCCATTTAACATTGTCCTTCCCCAT |
| 472 | GRHL1 | 2469168 | CTGGGCATTGATAAGAGAGGCCATCTGACAGCTCCAGATACGACAGTCACTGTCT |
| 473 | GRHL1 | 2469169 | TGCCTACCCACTCCATCAAGACAGAAACCC |
| 474 | GRHL1 | 2469170 | GGTGGTGGTTTTCGATCGGAATCTCAATACTGACCAGTTCAGCTCTGGTGCTCAAGCCCCAAA TGCTCAAAGGCGAACTCCAGACTCGACCTTCT |
| 475 | GRHL1 | 2469172 | CCCTCGGATCTCAGTCTGCGGATGCCTGGCATGAATTCAGAGGACTATGTTTTGACAGTG |
| 476 | GRHL1 | 2469173 | GAACAACTTTGAATATACCCTAGAAGCTTCAAA |

TABLE 13-continued

Subtyping Target Sequences

| SEQ ID NO. | Gene | Affy Probeset ID | Sequence |
|---|---|---|---|
| 477 | GRHL1 | 2469174 | AGCCAGGAGACAGTACCATGACGTACCTGAACAAAGGCCAGTTCTATCCCATCACCTTGAAG GAGGTGAGCAGCAGTGAAGGAATCCATCATCC |
| 478 | GRHL1 | 2469175 | GCAGAGAAGATCAGTTAAGGCATTGGAAGTACTGGCACTCCCGGCAGCACACCGCTAAACAA AGATGCATTGACATA |
| 479 | GRHL1 | 2469176 | CAAGAGCCCGCTTTTATTCCCAGAGGTGCAGCCATCCAGTTTTCTAAATCCAATTATTTTTGGC AGTGATCAGCTTCCTGCCGAAAGCATTTGAATTTTTATGCCAGCTACTGATCTGTTCCAAACAC TGTCCTCGGCCTCCTGGAACCAGTGCTCTCACCATTGCTCCCATGCAGTAATGGGACATGTGC CCACGTGGTGGCTTTCCACAGGACACTAGGGCCAGAAGCCATGTAGCTGGCTAACCTGAGAA TGTCCCCACTGTTCAGTCTGCAATTGCTTTAAGGGGTAATATCTTCTTTAAAAGATTCTGATTAT TATTTGGAGATGATGGAGGTAGAGAAAAAAACAAGTAAAAGAAAGATATTGCTGCTGTGCA GTTGCCTAACAGTCTTCCCTAGTCACGTGCTAAACCGTGTAACTAACCTCTCTGTGGGCTGTAG TGGCAAACCTGTGCAAATCTGTATTTACTGAAGTAGCGTTACACAGACCTCTGTTCTTGCCATG TATGTAATTTTCATGTAAAACCATTGTCTGTATCACAGATGGCTGTTTAATATTAGTGTTACTTT TTTTCTTTACCTTTTGTAATGCTCTTGTTTCCTTTTCAGGAGAATGAGAACTCAGTTCTAATCTT GGTTCTACAGAGTAGTTTTGTGACCTTGGGACTGTTATTTAAACTTTTTAGACTTAAATTTCCTA ATTGTGACATAATGAGATTGAATTAAATATGTCTAAGCTTGCCTCTATTACAAAAACTCTGTGA TTCTTTTTCTTCGTATTTTGAACTTCTTCTAATCGAACAAAATGTTAATTTAAATTGTCCAGAGG TGATAATGCTAAAAACTAGATCTTATTTTGAACTGCTGGGATCCCA |
| 480 | GRHL1 | 2469177 | AAAGAAAGCTTCAACACTATCAGTAACATCGAGGAGATTGCGTATAACGCCATTTCCTTCACA |
| 481 | GRHL1 | 2469178 | GGGCGCCTTATGTCCAGCCATTTGAGAAATGGGAGGAGTTTAATGATTTGACAACTGATTTTT TTTTTTTCACAGTTTTATGTGTTTCATTCTCAGGTGTTATGAAACTATCCTCTTCCCTTTTTATTC TCCCCTCCTCCAAAACAGATCATTTTTGTTGCCATCCTTTGCACAGAGTCCAGTGTGTGAAACA TTGAGATTAAGTTGCACTCTGCCACTCCTGCCTGTTCAGCCTTGAGTCTGACTCCTCATTTGCTT TGCCTCATTTCCTCATTTGCACAGTGGAGGTGATATCTGTCTCCTCCCTCTATTGAAGGAGGTG TAAGGAGTAATGAAACAATGCCCATCAAACTGTTGGAGTGGCTTTGAGAAAGGCTCTTAAAT ATAAGTGATTATTAGTAGTACTCTGTTTCATATCATCACCTTGTAAATATGACTCTGTGTTAAG ATTCTTCTGTCTTGGGCTTTTCCCATTGAAGAGTTGCCTCCAGTTCAGTTGGAGTAACTCTAAT TGGCTAGAGTTACTCCTTGTGGGCGACTCTAA |
| 482 | GRHL1 | 2469185 | AGGGGTTGCCTCTTAACATTCAAGTTGATACCTATAGTTACAACAACCGCAGCAACAAGCCTG TGCACCGGGCCTACTGCCAGATCAAGGT |
| 483 | GRHL1 | 2469186 | GCGGAAAATCAGGGATGAAGAACGAAAG |
| 484 | GRHL1 | 2469188 | TGATGTTAAAGTGCCACTGCTTCCC |
| 485 | GRHL1 | 2469190 | TTCCCATTGCCTCTGAAGAATTGGAGGGTGAA |
| 486 | GRHL1 | 2469193 | GGCCGTACGGCACAGAAGATGACTTTGCTGTCCCTCCTTCTACCAAGCTGGCCCGGATAGAA GAACCAAAGA |
| 487 | GRHL1 | 2469194 | TGCTGCTCTACGTTCGAAAGGAGTCAGAAGAAGTCTTTGATGCCCTGATGCTCAAAACCCCAT CTTTGAAGGGCTTGATG |
| 488 | GRHL1 | 2469196 | ATCTCAGACAAATACGATGTTCCCCATGACAA |
| 489 | GRHL1 | 2469198 | AACATGGACGACAACATTGTGAAGCATTACTCCAATGAGGACACCTTCCAGCTGCAGATTGAA GAAGCCGGGGGGTCTTACAAGCTCACCCTGACGGAGATCTAA |
| 490 | GRHL1 | 2469199 | CATGTCGCCAGCACAGGTCTATGTCGAGGGAATGGGTTCCTTGCAGGTTGGAGGCGGGGCT GCATCTGGCTTGGTGGTAGCATTTAATCTATTGCATTGGTGTTTTTCAGATGAAAGAGAAATC CATATACCATTATGTTTGAATTTCCTGATATATACAGGATTTAAAGTGAAAACTTTATTCCAAG AGTTAACAGAGTCTCTGGGAAGCTTTAGGACATCTGCTACGTTATTTATCAAAATATTGGGAT CTCTGCCTTGTGCCTACAGTGTCGTGGGCCTGCTCGCTAGCAGAAGTCAGAAAAGGCGATAG GCTTGGCTTTAAGGATTTCGTGCCCTTGCCTGAATTCAGTACAACTCCACTGCCTCACGTTAGC GGGAGCGCACCTGAAGAGTACGGGGGGAGCCCTCTCTCCCTTACCCTCTCACTCTCCACCAGA TGTTTACTAAACAGGGCATGTTACTGAAATCTTCCTTTGCGACTTTCTCGGACATATCAACTG |
| 491 | EPCAM | 2480965 | GAGCAGCGCTCCTCCGGTTAAAAGGAAGTCTCAGCACAGAATCTTCAAACCTCCTCGGAGGC CACCAAAGATCCCTAACGCCGCCATGGAGACGAAGCACCTGGGGCGGGGCGGAGCGGGGC GCGCGGGCCCACACCTGTGGAGGGGCCGCCCAACTGCAGCGCCGGGGCTGGGGGAG GGGAGCCTACTCACTCCCCCAACTCCCGGGCGGTGACTCATCAACGAGCACCAGCGGCCAGA |
| 492 | EPCAM | 2480966 | GCGCACAGAGCGCTAGTCCTTCGGCGAGCGAGCACCTTCGACGCGGTCCGGGGACCCCCTCG TCGCTGTCCTCCCGACGCGGACCCGCGTGCCCCAGGCCTCGCGCTGCCCGGCCGGCTCCTCGT GTCCCACTCCCGG |
| 493 | EPCAM | 2480967 | GCCCCTCTTCTCGGCGCGCGCGCAG |
| 494 | EPCAM | 2480968 | CAGGTCCTCGCGTTCGGGCTTCTGCTTGCCGCGGCGACGGCGACTTTTGCCGCAGCTCAGG |

TABLE 13-continued

Subtyping Target Sequences

| SEQ ID NO. | Gene | Affy Probeset ID | Sequence |
|---|---|---|---|
| 495 | EPCAM | 2480969 | GTGAGGCGCGGATTGGAGCAGAGTTGT |
| 496 | EPCAM | 2480970 | CAAGAGGCCGCGCTTTCCAGCGTGGAG |
| 497 | EPCAM | 2480972 | CAAGCTGGCCGTAAACTGCTTTGTGAATAATAATCGTCAATGCCAGTGTACTTCAGTTGGTGCACAAAA |
| 498 | EPCAM | 2480973 | TGGCTGCCAAATGTTTGGTGATGAAG |
| 499 | EPCAM | 2480974 | GAAGGGGCCCTCCAGAACAATGATGGGCTTTATGATCCTGACTGCGATGAGAGCGGGCTCTTTAAGGCCAAGCAGTGCAACGGCACCTCCATGTGCTG |
| 500 | EPCAM | 2480975 | GTGTGTGAACACTGCTGGGGTCAGAAG |
| 501 | EPCAM | 2480980 | TATGAGAATAATGTTATCACTATTGATCTGGTTCAAAATTCTTCTCAA |
| 502 | EPCAM | 2480981 | TTAAAGGTGAATCCTTGTTTCATTCTAAGAAAATGGACCTGACAGTAAATGGGGAACAACTGGATCTGGATCCTGGTCAAACTTTAATTTA |
| 503 | EPCAM | 2480982 | GTCTAAAAGCTGGTGTTATTGCTGTTATTGTGGTTGTGGTGATAGCAGTTGTTGCTGGAATT |
| 504 | EPCAM | 2480987 | ATGGGTGAGATGCATAGGGAACTCAATGCATAA |
| 505 | EPCAM | 2480988 | TGCGTGGGACGAAGACATCTTTGAAGGTCATGAGTTTGTTAGTTTAACATCATATATTTGTAATAGTGAAACCTGTACTCAAAATATAAGCAGCTTGAAACTGGCTTTACCAATCTTGAAATTTGACCACAAGTGTCTTATATATGCAGATC |
| 506 | EPCAM | 2480989 | ACTGATTTGTGATTGAAAGCTGCCTTTCTATTTACTTGAGTCTTGTACATACATTTTTTATGAGCTATGAAATA |
| 507 | ACTG2 | 2489010 | CCCAGATGTCATTCGTGCTGAAAGAACCAGAACAACTCTCTGCTCCCTGCCAAGCATGAAGCGGTTGTGACCCCAGGAAACCACAGTGACTTTGACTCTGGTTCAGCTGACATGCTCGAGTC |
| 508 | ACTG2 | 2489013 | GCTCCAGTCCCCAGCTCACTCAGCCACACACACC |
| 509 | ACTG2 | 2489014 | AGGAGACCACCGCGCTCGTGTGTGACAATGGCTCGGCCTGTGCAAGGCAGGCTTCGCAGGAGATGATGCCCCCGGGCTGTCTTCCCCTCCATTGTGGGCCGCCCTCGCCA |
| 510 | ACTG2 | 2489015 | GGCTCAGAGCAAGCGAGGGATCCTAACTCTCAAATACCCCATTGAACACGGC |
| 511 | ACTG2 | 2489017 | CTGCGTGTAGCACCTGAAGAGCACCCCACCCTGCTCACAGAGGCTCCCCTAAATCCCAAGGCCAACAGGGAAAAGATGACCCAG |
| 512 | ACTG2 | 2489019 | CCTGCCATGTACGTCGCCATTCAAGCTGTGCTCTCCCTCTATGCCTCTGGCCGCACGACA |
| 513 | ACTG2 | 2489020 | GGATTCAGGTGATGGCGTCACCCACAATGTCCCCATCTATGAAGGCTATGCCCTGCCCCATGCCATCATGCGCCTGGACTTGGCTGGCCGTGACCTCACGGACTACCTCATGAAGATCCTCACAGAGAGAGGCTATTCCTTTGTGAC |
| 514 | ACTG2 | 2489021 | AGAGAGAAATTGTGCGAGACATCAAG |
| 515 | ACTG2 | 2489022 | GGCAATGAGCGCTTCCGCTGCCCTGAGACCCTCTTCCAGCCTT |
| 516 | ACTG2 | 2489025 | GCATGGAGTCCGCTGGAATTCATGAGACAACCTACAATTCCATCATGAAGTGTGACATTGACATCCGTAAGGACTTATATGCCAAC |
| 517 | ACTG2 | 2489026 | AAGGAGATCACAGCCCTGGCCCCCAGCACCATG |
| 518 | ACTG2 | 2489029 | CCCAGAGCGGAAGTACTCAGTCTGGATCGGGGGCTCTATCCTGGCCTCTCTCTCCACCTTCCAGCAGATGTGGATCAGCAAGCCTGAGTATGATGAGGCAGGGCCCTCCATTGTCCACAGGAAGTGCT |
| 519 | ACTG2 | 2489030 | CAAGGATCCCCTCGAGACTACTCTGTTACCAGTCATGAAACATTAA |
| 520 | ACTG2 | 2489031 | CTCTTTTTTCCTGGGCTATGTCTCATACACAGTGCTAAGGACTTTTCACACATTACTTTTAATCCATGCAATAGTGCTGTAAGGTAGGTGCTATCATTATACCCATATTACAGATGAGGAAATTGAGGCTCAGAGAAGTCAAGGACTTGCGAAGATCACACAGATTCCAGA |
| 521 | TMSB10 | 2491288 | TGGGAGCACCAGGATCTCGGGCTCGGAAC |
| 522 | TMSB10 | 2491295 | CCATTGAGCAGGAGAAGCGGAGTGAAATTTCCTAA |
| 523 | TMSB10 | 2491296 | AAGAGCCACCTGCAAGATGGACACGAGC |

TABLE 13-continued

Subtyping Target Sequences

| SEQ ID NO. | Gene | Affy Probeset ID | Sequence |
|---|---|---|---|
| 524 | TMSB10 | 2491297 | CCCCCCAATCGGACTGCCAAATTCTCCGGTTTGCCCCG |
| 525 | MAL | 2493859 | CAGGCCACTGGGCTCCGCGGAGCCAGCGAGAGGTCTGCGCGGAGTCTGAGCGGCGCTCGTC CCGTCCCAAGGCCGACGCCAG |
| 526 | MAL | 2493860 | TGCCCAGTGGCTTCTCGGTCTTCACCACCTTGCCCGACTTGCTCTTCATCTT |
| 527 | MAL | 2493865 | TGGGTGATGTTCGTGTCTGTGTTCTGCTTCGTGGCCACCACCACCTTGATCATCCTGTACATAA TTGGAGCCCACGGTGGAG |
| 528 | MAL | 2493866 | CACCGCTGCCCTCTTTTACCTCAGCGCCTCAGTCCTGGAGGCCCTGGCCACCATCACGATGCA AGACGGCTTCACCTACAGGCACTACCATGAAAAC |
| 529 | MAL | 2493868 | GTGTTCTCCTACATAGCCACTCTGCTCTACGTGGTCCATGCGGTGTTCTCTTTAATCA |
| 530 | MAL | 2493869 | TGCTGTGTTTACTCTCCCGTGTGCCTTCGCGTCCGGGTTGGGAGCTTGCTGTGTCTAACCTCCA ACTGCTGTGCTGTCTGCTAGGGTCACCTCCTGTTTGTGAAAGGGGACCTTCTTGTTCGGGGT GGGAAGTGGCGACCGTGACCTGAGAAGGAAAGAAAGATCCTCTGCTGACCCCTGGAGCAGC TCTCGAGAACTACCTGTTGG |
| 531 | RALBP1 | 2496248 | GATTGCACAAGAGATAGCCAGTCTTTCAAAAGAGG |
| 532 | ITGA6 | 2515628 | GCTCATTCAGCGGTCGCGAGCTGCCCGCGAGGGGAGCGGCCGGACGGAGAGCGCGACCC GTCCCGGGGGTGGGGCCGGGCGCAGCGGCGAGAGGAGGCGAAGGTGGCTGCGGTAGCAG CAGCGCGGCAGCCTCGGACCCAGCCCGGAGCGCAG |
| 533 | ITGA6 | 2515629 | GCTGTGCTTGCTCTACCTGTCGGCGGGGCTCCTGTCCCGGCTCGGCGCAGCCTTCAACTTGGA CACTCGGGAGGACAACGTGATCCGGAAATATGGAGACCCCGGGAGCCTCTTCGGCTTCTCGC TGGCCATGCACTGGCAACTGCAGCCCGAGGACA |
| 534 | ITGA6 | 2515643 | CGGGCAGAAGCGCTTCCACTGCAGAGAGCCAACAGAACGGGAGGGCTGTACAGCTGCGACA TCACCGCCCGGGGGCCATGCACGCGGATCGAGTTTGATA |
| 535 | ITGA6 | 2515645 | TGACCCCACGTCAGAAAGCAAGGAAGATCAGTGGATGGGGGTCACCGTCCAGAGCCAAGGT CC |
| 536 | ITGA6 | 2515646 | TGTGCTCACCGATATGAAAAAAGGCAGCATGTTAATACGAAGCAGGAATCCCGAGACATCTT TGGGCGGTGTTATGTCCTGAGTCAGAATCTCAGGATTGAAGACGATATGGATG |
| 537 | ITGA6 | 2515653 | GACCAGCGTTTCCTATACAGATCCTGATCAGTTTGTTTATAAAACACGGCCTCCCCGGGAGCA GCCTGACACATTCCCTGATGTGATGATGAATAGCTACCTA |
| 538 | ITGA6 | 2515654 | TCTGGTGCTCCCAGAGCCAATCACAGTGGAGCCGTGGTTTTGCTGAAGAGAGACATGAAGTC TGCACATCTCCTCCCTGAGCACATATTCGATGGAGAAGGTCTGGCCTCTTCATTT |
| 539 | ITGA6 | 2515655 | GTTGGAGGTGCAGTGTATGTCTACATGAACCAGCAAGGCAGATGGAATAATGTGAAGCCAAT TCGTCTTAATGGAACCAAAGATTCTATGTTTGGCATTGCAGTAAAAAATATTGGAGATATTAA TCAAGATGGCTA |
| 540 | ITGA6 | 2515656 | ATATTGCAGTTGGAGCTCCGTATGATGACTTGGGAAAGGTTTTTATCTATCATGGATC |
| 541 | ITGA6 | 2515657 | CACCTTATTTTGGATATTCAATTGCTGGAAACATGGACCTTGATCGAAATTCCTACCCTGATGT TGCTGTTGGTTCCCTCTCAGATTCAGTAACTATTT |
| 542 | ITGA6 | 2515658 | TCCCGGCCTGTGATTAATATTCAGAAAACCATCACAGTAACTCCTAACAGAATTGACCTCCGCC AGAAAACAGCGTGTGGGCGC |
| 543 | ITGA6 | 2515661 | AGAAAATCTGGGCTATCCTCAAGAGTTCAGTTTCGAAACCAAGGTTCTGAGCCCAAATATACT CAAG |
| 544 | ITGA6 | 2515662 | TCAGAGATAAACTGCGTCCCATTCCCATAACTGCCTCAGTGGAGATCCAAGAGCCAAGCTCTC GTAGGCGAGTGAATTCACTTCCAGAAGTTCTTCCAATTCTGAATTCAGATGAACCCAAGACAG CTCATATTG |
| 545 | ITGA6 | 2515663 | ACTTCTTAAAAGAGGGATGTGGAGACGACAATGTATGTAACAGCAACCTTAAACTAGAATAT AAATTTTGCACCCGAGAAGG |
| 546 | ITGA6 | 2515664 | CCCAAGGAATCCCACAAAAGATGGCGATGACGCCCATGAGGCTAAACTGATTGCAACGTTTC CAGACACTTTAACCTATTCTGCATATA |
| 547 | ITGA6 | 2515665 | GTTGTGTTGCCAACCAGAATGGCTCGCAAGCTGACTGTGAGCTCGGAAATCCTTTTAAA |
| 548 | ITGA6 | 2515666 | TTGGTTTTAAGTACAACTGAAGTCACCTTTGACACCCCAGATCTGGATATTAATCTGAAGT |

TABLE 13-continued

Subtyping Target Sequences

| SEQ ID NO. | Gene | Affy Probeset ID | Sequence |
|---|---|---|---|
| 549 | ITGA6 | 2515668 | TTCCCAGGTGTATTTTGGAGGTACAGTTGTTGGCGAGCAAGCTATGAAATCTGAAGATGAAG<br>TGGGAAGTTTAATAGAGTATGAATTC |
| 550 | ITGA6 | 2515669 | AAACCTCTTACAAACCTCGGCACAGCAACCTTGAACATTCAGTGGCCAAAAGAAATTAGCAAT<br>GGGAAATGGTTGCTTTATTTGGTGAAAGTAGAATCCA |
| 551 | ITGA6 | 2515670 | TAACTTGTGAGCCACAAAAGGAGATAAACTCCCTGAA |
| 552 | ITGA6 | 2515672 | CTTGCTGGTTTTACACTTACTTCTGTGCCTTTGGCAGGAGAGAGGCAAATATTGTTGATTATGT<br>GAATCTGGCACTGTTTGGGAGGATATGCTCAAGAGGCTTGTATGGTAATGACAAAG |
| 553 | ITGA6 | 2515673 | AACAGATAGATGATAACAGAAAATTTTCTT |
| 554 | ITGA6 | 2515674 | TGTGTGAACATCAGATGCCCGCTGCGGGGGCTGGACAGCAAGGCGTCTCTTATTTTGCGCTC<br>GAGGTTATGGAACAGCACATTT |
| 555 | ITGA6 | 2515675 | GGACATTCTCATGCGAGCCTTCATTGATGTGACTGCTGCTGCCGAAAATATCAGGCTGCCAAA<br>TGCAGGCACTC |
| 556 | ITGA6 | 2515677 | TTTCCCTCAAAGACTGTAGCTCAGTATTCGGGAGTACCTTGGTGGATCATCCTAGTGGCTATTC<br>TCGCTGGGATCTTGATGCTTGCTTTATTAG |
| 557 | ITGA6 | 2515679 | TATGATGCCACATATCACAAGGCTGAGATCCATGCTCAGCCATCTGATAAAGAGAGGCTTACT |
| 558 | ITGA6 | 2515683 | GTGGATTCTTTAAACGCTCTAGGTACGATGACAGTGTTCCCCGATACCATGCTGTAAGGATCC<br>GGAAAGAAGAGCGAGAGATC |
| 559 | ITGA6 | 2515684 | TCACAAAGTGGAACGAAAATGAAAGCTACTC |
| 560 | ITGA6 | 2515685 | TGCCCAGTTGCACTCAGGTGACATCCTCCAGATAGTGTAGCTGAGGAGGCACCTACACTCACC<br>TGCACTAACAGAGTGGCCGTCCTAACCTCGGGCCTGCTGCGCAGACGTCCATCACGTTAGCTG<br>TCCCACATCACAAGACTATGCCATTGGGGTAGTTGTGTTTCAACGGAAAGTGCTGTCTTAAAC<br>TAAATGTGCAATAGAAGGTGATGTTGCCATCCTACCGTCTTTTC |
| 561 | ITGA6 | 2515686 | GGTGAATGCCTATGGTGGATCCAAACTGATCCAGTATAAGACTACTGAATCTGCTACCAAAAC<br>AGTTAATCA |
| 562 | ITGA6 | 2515687 | AGTCTCAGTTTCTTGCTTGGGGAACTTGTGTCCCTAATGTGTTTAGATTGCTAGATTGCTAAGG<br>AGCTGATACTTTGACAGTGTTTTTAGACCTGTGTTACTAAAAAAAAGATGAATGTCCTGAAAA<br>GGGTGTTGGGAGGGTGGTTCAACAAAGAAACAAAGATGTTATGGTGTTTAGATTTATGGTTG<br>TTAAAAATGTCATCTCAAGTCAAGTCACTGGTCTGTT |
| 563 | COL3A1 | 2519582 | TGAGTTTTATGACGGGCCCGGTGCTGAAGGGCAGGGAACAACTTGATGGTGCTACTTTGAAC<br>TGCTTTTCTTTTCTCCTTTTTGCACAAAGAGTCTCATGTCTGATATTTA |
| 564 | COL3A1 | 2519583 | ATGAGCTTTGTGCAAAAGGGGAGCTGGCTACTTCTCGCTCTGCTTCATCCCACTATTATTTGG<br>CACAACAGGAA |
| 565 | COL3A1 | 2519585 | CTGTTGAAGGAGGATGTTCCCATCTTGGTCA |
| 566 | COL3A1 | 2519586 | GTTCTCTGCGATGACATAATATGTGACGATCAAGAATTAGACTGCCCCAACCCAGAAATTCCA<br>TTTGGAGAATGTTGTGCAGTTTGCCCACA |
| 567 | COL3A1 | 2519587 | CCTACTCGCCCTCCTAATGGTCAAGGACCTCAAGGCC |
| 568 | COL3A1 | 2519591 | ACCCCCTGGTGAACCTGGGCAAGCT |
| 569 | COL3A1 | 2519592 | GGACCTCCTGGTGCTATAGGTCCAT |
| 570 | COL3A1 | 2519594 | CAAAGGTCCAGCTGGGATACCTGGAT |
| 571 | COL3A1 | 2519596 | GGTGAAAATGGTCTTCCAGGCGAAAATGGAGCTCCT |
| 572 | COL3A1 | 2519597 | GGTGAGCGAGGACGGCCAGGACTTCCTGGGGC |
| 573 | COL3A1 | 2519599 | CTGGAACTGCCGGATTCCCTGGATCCCCTGGTGCTAA |
| 574 | COL3A1 | 2519600 | CCTGCAGGGTCTCCTGGTTCAAATGGTGCCC |
| 575 | COL3A1 | 2519604 | GTGAGGCTGGTATTCCAGGTGTTCCAGGAGCTAAAGGCGAAGATGGCAAGGAT |
| 576 | COL3A1 | 2519605 | GTGCCCCTGGGTTCCGAGGACCTGCTGGACCAAATGGCATCCCAGGAGAAA |

TABLE 13-continued

Subtyping Target Sequences

| SEQ ID NO. | Gene | Affy Probeset ID | Sequence |
|---|---|---|---|
| 577 | COL3A1 | 2519606 | CCTGCTGGAGAGCGTGGTGCTCCAG |
| 578 | COL3A1 | 2519607 | GAAGTGATGGGAAACCAGGGCCTCC |
| 579 | COL3A1 | 2519608 | TCAAGGAGAAAGTGGTCGACCAGGTCCTCCTGGGCCATCTGGTCCCCGAGGTCAGCCTGGTG TCATGGGCTTCCCCGGTCCTAAA |
| 580 | COL3A1 | 2519610 | TGGTAAGAATGGAGAACGAGGTGGCCCT |
| 581 | COL3A1 | 2519611 | GAAAGAATGGTGAAACTGGACCTCAGGGAC |
| 582 | COL3A1 | 2519612 | CCTGGTGGTGACAAAGGAGACACAGGACCCCCTGGTCCACAAGGATTACA |
| 583 | COL3A1 | 2519613 | GGCTTGCCTGGTACAGGTGGTCCTCCAGGAGA |
| 584 | COL3A1 | 2519614 | GGTCCAAAGGGTGATGCCGGTGCACCTGGA |
| 585 | COL3A1 | 2519615 | GTGCCCCTGGTGAACGTGGACCTCCTG |
| 586 | COL3A1 | 2519616 | GGAGGTCTTGGAAGTCCTGGTCCAAAG |
| 587 | COL3A1 | 2519617 | AACCAGGCGGTCCAGGTGCTGATGGTGTCCCA |
| 588 | COL3A1 | 2519618 | GGTCCTACTGGTCCTATTGGTCCTCCTGGCCCAG |
| 589 | COL3A1 | 2519620 | GTGAGAGAGGTGAAACTGGCCCTCCAGGACCTGCTGGTTTCCCTGGT |
| 590 | COL3A1 | 2519621 | GACAGAATGGTGAACCTGGTGGTAAAGGAGAAAGAGGGGCTCCGGGTGAGAAAGGTGAAG GAGGCCCTCCTG |
| 591 | COL3A1 | 2519623 | CCTGGTCCCCAAGGTGTCAAAGGTGAACGTGGCAGTCCTGGTGG |
| 592 | COL3A1 | 2519626 | GCTTCCCTGGTGCTCGTGGTCTTCC |
| 593 | COL3A1 | 2519627 | TTCTCATCATACACTTCAGAAAGAGCATTCATGTATGTATAGGATGAGAAACTTACACATTGCT ACTTATTTCTCTAGTAAGTCTCA |
| 594 | COL3A1 | 2519628 | TCCCAGCGGTTCTCCAGGCAAGGATGGGCCCCCAGGTCCTGCGGGTAACACTGGTGCTCCTG GCAGCCCTGGAGTGTCTGGACCAAAAGGTG |
| 595 | COL3A1 | 2519629 | GCCCACTTGGGATTGCTGGGATCACTGGAGCACGGGGTCTTGCAG |
| 596 | COL3A1 | 2519630 | ATGCCAGGTCCTAGGGGAAGCCCTG |
| 597 | COL3A1 | 2519631 | TGGGAAACCAGGAGCTAACGGTCTCAGTGGAGAACGTGGTCCCCCTGGACCCCAGGGTCTTC CTGGTCTGGCTGGTACAGCTGGTGAACCTG |
| 598 | COL3A1 | 2519635 | GCCCACCTGGTCCTGTCGGTCCAGC |
| 599 | COL3A1 | 2519636 | GCCCTGCTGGTGCTCCCGGTCCTGCTGGTTCCCGAG |
| 600 | COL3A1 | 2519637 | GTGACAAAGGTGAAACAGGTGAACGTGGAGCTGCTGGCATCAAAGGACATCGAGGATTCCC TGGTAATCCA |
| 601 | COL3A1 | 2519638 | CAGCAGGGTGCAATCGGCAGTCCAGGACCT |
| 602 | COL3A1 | 2519641 | CAGGTCCCATTGGACCACCAGGGCCTCGAGGTAACAGAG |
| 603 | COL3A1 | 2519642 | TGTCCACATTGCTATCCCACTAGAGATCTCAGAATTACAACATTCATAATTATCTGCGTTTATGT AGTGCATTTTACTTCTCAAACAGCTTCCATGGTTACTATTTTGTTAATGATACTATCATTCCTAA TACTTTCTATTCCATGCCTTTGGGTAAATGAAATAAAAACAATTATCCCAACAAATTACACTCC CCTCTGTCATGTCAATATTGGAATTGTAGCTCACAGGTGTTTGCTTACATCAGTCATCCAGAAG GAAGAATGATAGAGAAACTTGTGCTCTGACACTACTGATTCTTACATAGTGGAACAATATCT TTCTTGATAATGAATTGTAGTTATTATAAATCGGTGATCACGTGACCCTAAAGGCACCCAAAT AAATCTTTAGTAAAATAATTCTGATGACACAATGAATGAATTATTTTTAAGGCATTTTCTTGGA CTAGCAATGTATTCTTAGAGTGGCGACTGAATGTGCATACCTCA |
| 604 | COL3A1 | 2519643 | CACCCAGGGCAACCAGGCCCTCCTGGACCTCCTGGTGCCCCTGGTCCTTGCTGTG |
| 605 | COL3A1 | 2519644 | GTGGTGTTGGAGCCGCTGCCATTGCTGGG |
| 606 | COL3A1 | 2519645 | CACCGATGAGATTATGACTTCACTCAAGTCTGTTAATGGACAAATAGAAAGCCTCATTAGTCC TGATGGTTCTCGTAAAAACCCCGCTAGAAACTGCAGAGACCTGAAATTCTGCCATCCTGAAC |

TABLE 13-continued

Subtyping Target Sequences

| SEQ ID NO. | Gene | Affy Probeset ID | Sequence |
|---|---|---|---|
| 607 | COL3A1 | 2519647 | GAGAATACTGGGTTGACCCTAACCA |
| 608 | COL3A1 | 2519648 | TTGGATGCTATCAAGGTATTCTGTAATATGGAA |
| 609 | COL3A1 | 2519649 | TTTGAATGTTCCACGGAAACACTGGTGGACAGATTCTAGTGCTGAGAAGAAACACGTTTGGTT TGGAGAGTCCATGGATGGTGGTTTTCAG |
| 610 | COL3A1 | 2519650 | AATAAGTCACCTCTATATCCTTTGTATTCTTCCTATATGTTCATCACAAAGCAAAGTTACTAGGT TGGTACAAACATAATTGCAGTTTTTGCTACTGAAAGTGATGGCATGCAATAAAAATATTTTCA CACATAAAATACTCGTACATAAAATATATAAACAGCCCATATTACAATATGCATACACATACTA CATGAATCCCTCGCGTGCAG |
| 611 | COL3A1 | 2519651 | TTACAACTGAAATGTTTGATCTGTTTTATTTGTTCCCTATTACAG |
| 612 | COL3A1 | 2519652 | AGATGTCCTTGATGTGCATCTGGCATTCCTTCGACTTCTCTCCAGCCGAGCTTCCCAGAACATC ACATATCACTGCAAAAATAGCATTGCATACATGGATCAGGCCAGTG |
| 613 | COL3A1 | 2519653 | TGAATTCAAGGCTGAAGGAAATAGCAAATTCACCTACACAGTTCTGGAGGA |
| 614 | COL3A1 | 2519656 | TTTGAATATCGAACACGCAAGGCTGTGAGACTACCTATTGTAGATATTGCACCCTATGACATT GGTGGTCCTGATCAAGAATTTGGT |
| 615 | COL3A1 | 2519657 | CTCTTGTTCTAATCTTGTCAACCAGTGCAAGTGACCGACAAAATTCCAGTTATTTATTTCCAAA ATGTTTGGAAACAGTATAATTTGACAAAGAAAATGATACTTCTCTTTTTTTGCTGTTCCACCA AATACAATTCAAATGCTTTTTGTTTTATTTTTTTACCAATTCCAATTTCAAAATGTCTCAATGGT GCTATAATAAA |
| 616 | COL3A1 | 2519658 | GAGCAATGACTGTGCTCACCAGTAAAAGATAACCTTTCTTTCTGAAATAGTCAAATACGAAAT TAGAAAAGCCCTCCCTATTTTAACTACCTCAACTGGTCAGAAACACAGATTGTATTCTATGAGT CCCAGAAGATGAAAAAAATTTTATACGTTGATAAAACTTATAAATTTCATTGATTAATCTCCTG GAAGATTGGTTTAAAAAGAAAAGTGTAATGCAAGAATTTAAAGAAATATTTTTAAAGCCACA ATTATTTTAATATTGGATATCAACTGCTTGTAAAGGTGCTCCTCTTTTTTCTTGTCATTGCTGGT CAAGATTACTAATATTTGGGAAGGCTTTAAAGACGCATGTTATGGTGCTAATGTA |
| 617 | COL3A1 | 2519659 | GAAAGATTCATTGGCATGCCACAGGGGATTCTCCTCC |
| 618 | COL3A1 | 2519660 | AAATTATGGGGCTGCTTTTGTCACACTAGCATAGAGAATGTGTTGAAATTTAACTTTGTAAGC TTGTATGTGGTTGTTGATCTTTTTT |
| 619 | DES | 2528478 | ATGAGCCAGGCCTACTCGTCCAGCCAGCGCGTGTC |
| 620 | DES | 2528479 | TGAGTTCGCCCGTGTTCCCGCGGGCGGGTTTCGGCTCTAAGGGCTCCTCCAGCTCGGTGACGT CCCGCGTGTACCAGGTGTCGCGCA |
| 621 | DES | 2528480 | GGCCTGGGGTCGCTGCGGGCCAGCCGGC |
| 622 | DES | 2528481 | TGGACTTCTCACTGGCCGACGCGGTGAACCAGGAGTTTCTGACCACGCGCACCAACGAGAAG GTGGAGCTGCAGGAGCTCAATGACCGCTTCGCCAACTACATCGAGAAGGTGCGCTTCCTGGA GCAGCAGAACGCGGCGCTCGCCGCCGAAGTGAACCGGCTCAA |
| 623 | DES | 2528482 | TGCTCACTAACCAGCGCGCGCGCGTCGACGTCGAGCGCGACAACCTGCTCGACGACCTGCAG CGGCTCAA |
| 624 | DES | 2528483 | GCTACTCTAGCTCGCATTGACCTGGAGCGCAGAATTGAATCTCTCAACGAGGAGATCGCGTTC CTTAAGAAAGTGCA |
| 625 | DES | 2528484 | CCTCAGGGACATCCGGGCTCAGTATGAGACCATCGCGGCTAAGAACATTTCTGAAGCTGAGG AGTGGTACAAG |
| 626 | DES | 2528485 | GTGTCAGACCTGACCCAGGCAGCCAACAAGAACAACGACGCCCTGCGCCAGGCCAAGCAGG AGATGATGGAATACCGACACCAGATCCAGTCCTACACCTGCGAGATTGACGCCCTGAAG |
| 627 | DES | 2528486 | CGGGAATTGGAGGACCGATTTGCCAGTGAGGCCAGTGGCTACCAGGACAACATTGCGCGCCT GGAGGAGGAAATCCGGCACCTCAAGGATGAGATGGCCCGCCATCTG |
| 628 | DES | 2528488 | CCCATCCAGACCTACTCTGCCCTCAACTTCCGAG |
| 629 | DES | 2528489 | TTGGGGTCTGCTAGGGCTCTGCCCA |
| 630 | DES | 2528490 | AGCCTGGACTTGGTCAGGCTGAGTGTGCGATGGACCCTGTTACAG |
| 631 | DES | 2528491 | AAGGGGTTCTGAGGTCCATACCAAGAAGACGGTGATGATCAAGACCATCGAGACACGGGAT GG |

TABLE 13-continued

Subtyping Target Sequences

| SEQ ID NO. | Gene | Affy Probeset ID | Sequence |
|---|---|---|---|
| 632 | DES | 2528492 | GTCGTCAGTGAGGCCACACAGCAGCAGCATGAAGTGCTCTAA |
| 633 | DES | 2528493 | CTGCCACCAGAGACCGTCCTCACCCC |
| 634 | DES | 2528494 | TGGTCCCCAACAGCGACATAGCCCATCCCTGCCTGGTCACAGGGCATGCCCCGGCCACCT |
| 635 | DES | 2528495 | CAGGTAGCCAGGGGGACTAGCCCCTGTGGAGACTGGGGGGCTTGAAATTGTCCCCGTGGTCTCTTAC |
| 636 | DES | 2528496 | CTACAAGAGGGAATCCCCGAAGGTGCTGGAG |
| 637 | DES | 2528497 | GAAAGTGGGTGAGATGCTGGAGAAGAGAGGAGAGGAGAGAGGCAGAGAGCGGTCTCAGGC |
| 638 | UGT1A8 | 2533024 | CAGCTTAGAATCCCAGCTGCTGGCTCGGGCTGCAGTTCTCTC |
| 639 | UGT1A8 | 2533025 | ATGGCTCGCACAGGGTGGACCAGCCCCATTCCCCTATGTGTTTCTCTGCTGCTGAC |
| 640 | UGT1A8 | 2533026 | TGGGAGTCACTGGTTCACCATGCAG |
| 641 | UGT1A8 | 2533027 | TATTTCTGAGTTCATCCAATGGTTTT |
| 642 | UGT1A8 | 2533028 | GAGTACGGAACCACATCATGCACTTGGAGGAACATTTATTTTGCCAGTATTTTTCCAAAAATGCCCTAGAAATAGCCTCTGAAATTCTCCAAACACCTGTCACAGCATATGATCTCTACAGCCACACATCAATTTGGTTGTTGCGAACAGACTTTGTTTTGGACTATCCCAAACCCGTGATGCCCAATATGATCTTCATTGGTGGTATCAACTGCCATC |
| 643 | UGT1A8 | 2533035 | CAGCTTAGAATCCCAGCTGCTGGCTCGGGCTGCAGTTCTCTC |
| 644 | UGT1A8 | 2533036 | ATGGCTCGCGCAGGGTGGACCAGCCCCGTTCCTTTATGTGTGTGTCTACTGC |
| 645 | UGT1A10 | 2533036 | ATGGCTCGCGCAGGGTGGACCAGCCCCGTTCCTTTATGTGTGTGTCTACTGC |
| 646 | UGT1A8 | 2533037 | TGGGAGTCACTGGTTCACCATGCAG |
| 647 | UGT1A8 | 2533038 | GTGAGTTGGCAACTGGAAAGATCACTGAATTGCACA |
| 648 | UGT1A10 | 2533038 | GTGAGTTGGCAACTGGAAAGATCACTGAATTGCACA |
| 649 | UGT1A8 | 2533039 | CTCTGGAAGATCAGAACCGGGAATTCATGGTTTTCGCCCATGCTCAATGGAAAGCACA |
| 650 | UGT1A10 | 2533039 | CTCTGGAAGATCAGAACCGGGAATTCATGGTTTTCGCCCATGCTCAATGGAAAGCACA |
| 651 | UGT1A8 | 2533040 | CTCTATTAATGAGTTCATCCAGTGGT |
| 652 | UGT1A10 | 2533040 | CTCTATTAATGAGTTCATCCAGTGGT |
| 653 | UGT1A8 | 2533041 | TCTGGATCCTTTTGATACCTGTGGCTTAATTGTTGCTAAATATTTCTCCCTCCCCTCTGTGGTCTTCACCAGGGGAATATTTTGCCACCATCTTGAAGAAGGTGCACAGTGC |
| 654 | UGT1A10 | 2533041 | TCTGGATCCTTTTGATACCTGTGGCTTAATTGTTGCTAAATATTTCTCCCTCCCCTCTGTGGTCTTCACCAGGGGAATATTTTGCCACCATCTTGAAGAAGGTGCACAGTGC |
| 655 | UGT1A8 | 2533042 | TCAATTTGGTTGTTGCGAACGGACTTTGTTTTGGACTATCCCAAACCCGTGATGCCCAACATGATCTTCA |
| 656 | UGT1A10 | 2533042 | TCAATTTGGTTGTTGCGAACGGACTTTGTTTTGGACTATCCCAAACCCGTGATGCCCAACATGATCTTCA |
| 657 | UGT1A8 | 2533047 | TAAGGAACCACATCTTCTACTTAGAGGAGCATTTATTTTGCCCATATTTTTTCAAAAATGCCTTAAACATAGCCTCTGAAATTC |
| 658 | UGT1A10 | 2533047 | TAAGGAACCACATCTTCTACTTAGAGGAGCATTTATTTTGCCCATATTTTTTCAAAAATGCCTTAAACATAGCCTCTGAAATTC |
| 659 | UGT1A8 | 2533048 | CATCAATTTGGTTGCTGCGAATGGA |
| 660 | UGT1A10 | 2533048 | CATCAATTTGGTTGCTGCGAATGGA |
| 661 | UGT1A8 | 2533050 | GCTTAGATTCCCAGCTGCTTGCTCT |
| 662 | UGT1A10 | 2533050 | GCTTAGATTCCCAGCTGCTTGCTCT |
| 663 | UGT1A9 | 2533050 | GCTTAGATTCCCAGCTGCTTGCTCT |

TABLE 13-continued

Subtyping Target Sequences

| SEQ ID NO. | Gene | Affy Probeset ID | Sequence |
|---|---|---|---|
| 664 | UGT1A8 | 2533051 | ATGGCTTGCACAGGGTGGACCAGCCCCCTTCCTCTATGTGTGTGTCTGCTGCTGACCTGTGGC<br>TTTGCCGAG |
| 665 | UGT1A10 | 2533051 | ATGGCTTGCACAGGGTGGACCAGCCCCCTTCCTCTATGTGTGTGTCTGCTGCTGACCTGTGGC<br>TTTGCCGAG |
| 666 | UGT1A9 | 2533051 | ATGGCTTGCACAGGGTGGACCAGCCCCCTTCCTCTATGTGTGTGTCTGCTGCTGACCTGTGGC<br>TTTGCCGAG |
| 667 | UGT1A8 | 2533054 | TATTCAACTTCATATACCCTGGAGGATCTGGACCGGGAGTTCAAGGCTTTTGCCCATGCTCAA<br>TGGAAAGCACAAGTACGAAGTATATATTCTCTATTAATGGGTTCATACAATGACATT |
| 668 | UGT1A10 | 2533054 | TATTCAACTTCATATACCCTGGAGGATCTGGACCGGGAGTTCAAGGCTTTTGCCCATGCTCAA<br>TGGAAAGCACAAGTACGAAGTATATATTCTCTATTAATGGGTTCATACAATGACATT |
| 669 | UGT1A9 | 2533054 | TATTCAACTTCATATACCCTGGAGGATCTGGACCGGGAGTTCAAGGCTTTTGCCCATGCTCAA<br>TGGAAAGCACAAGTACGAAGTATATATTCTCTATTAATGGGTTCATACAATGACATT |
| 670 | UGT1A8 | 2533057 | TTTCAAGGAGAGAGTACGGAACCACATCATGCACTT |
| 671 | UGT1A8 | 2533058 | CTCCAAACACCTGTTACGGAGTATGATCTCTACAGC |
| 672 | UGT1A10 | 2533058 | CTCCAAACACCTGTTACGGAGTATGATCTCTACAGC |
| 673 | UGT1A9 | 2533058 | CTCCAAACACCTGTTACGGAGTATGATCTCTACAGC |
| 674 | UGT1A8 | 2533065 | ATGGCTCGTGCAGGGTGGACTGGCCTCCTTCCCCTATATGTGTGTCTACTGCTGAC |
| 675 | UGT1A10 | 2533065 | ATGGCTCGTGCAGGGTGGACTGGCCTCCTTCCCCTATATGTGTGTCTACTGCTGAC |
| 676 | UGT1A9 | 2533065 | ATGGCTCGTGCAGGGTGGACTGGCCTCCTTCCCCTATATGTGTGTCTACTGCTGAC |
| 677 | UGT1A8 | 2533067 | TGCAGTCGGTGGTGGAGAAACTCATCCTCAGGGGGCATGAGGTGGTCGTAGTCATGCCAGA |
| 678 | UGT1A10 | 2533067 | TGCAGTCGGTGGTGGAGAAACTCATCCTCAGGGGGCATGAGGTGGTCGTAGTCATGCCAGA |
| 679 | UGT1A9 | 2533067 | TGCAGTCGGTGGTGGAGAAACTCATCCTCAGGGGGCATGAGGTGGTCGTAGTCATGCCAGA |
| 680 | UGT1A8 | 2533068 | AGTTCATGGTTTTTGCCGATGCTCGCTGGACGGCACCATTGCGAAGTGCATTTTCTCTATTAAC<br>AAGTTC |
| 681 | UGT1A10 | 2533068 | AGTTCATGGTTTTTGCCGATGCTCGCTGGACGGCACCATTGCGAAGTGCATTTTCTCTATTAAC<br>AAGTTC |
| 682 | UGT1A9 | 2533068 | AGTTCATGGTTTTTGCCGATGCTCGCTGGACGGCACCATTGCGAAGTGCATTTTCTCTATTAAC<br>AAGTTC |
| 683 | UGT1A8 | 2533072 | GGGTCTCCAGCGGAGCTACTCTTTAGGGATCGTCATTATGACGAACAGACATGCCAGATTCCT<br>CTGGCTAGTGTCCAGTGCAGACATACACACACACACATACACACACACACACACACACA<br>CCATTCTTAGTACAGTCAAAGCTCACAGGAGAAAGAAAAATGTTTTCTAATACCTTCTTAATTT<br>GCAAGAAGGTGTTAGGAATTCAAGGGATGGTATGCATAGTGATGTTAGTTTCATTTCTTCAGC<br>TCCTTCCTCCAACTCATGTTCTGTAGGGACTTCTGGGACTAAGAACAGGACCCACATATGAGC<br>AACAGGATTTTCAGAGCAAGGCTGTGGTTGGAAGGGCTCAGACCAACGTCCACAGCAGAGT<br>GGAGGTCTAGTATAAAGAATGTGAAGTTTGTAGCATCTCTTGATCCCGCTATTCCTACATGCTTG |
| 684 | UGT1A10 | 2533072 | GGGTCTCCAGCGGAGCTACTCTTTAGGGATCGTCATTATGACGAACAGACATGCCAGATTCCT<br>CTGGCTAGTGTCCAGTGCAGACATACACACACACACATACACACACACACACACACACA<br>CCATTCTTAGTACAGTCAAAGCTCACAGGAGAAAGAAAAATGTTTTCTAATACCTTCTTAATTT<br>GCAAGAAGGTGTTAGGAATTCAAGGGATGGTATGCATAGTGATGTTAGTTTCATTTCTTCAGC<br>TCCTTCCTCCAACTCATGTTCTGTAGGGACTTCTGGGACTAAGAACAGGACCCACATATGAGC<br>AACAGGATTTTCAGAGCAAGGCTGTGGTTGGAAGGGCTCAGACCAACGTCCACAGCAGAGT<br>GGAGGTCTAGTATAAAGAATGTGAAGTTTGTAGCATCTCTTGATCCCGCTATTCCTACATGCTTG |
| 685 | UGT1A9 | 2533072 | GGGTCTCCAGCGGAGCTACTCTTTAGGGATCGTCATTATGACGAACAGACATGCCAGATTCCT<br>CTGGCTAGTGTCCAGTGCAGACATACACACACACACATACACACACACACACACACACA<br>CCATTCTTAGTACAGTCAAAGCTCACAGGAGAAAGAAAAATGTTTTCTAATACCTTCTTAATTT<br>GCAAGAAGGTGTTAGGAATTCAAGGGATGGTATGCATAGTGATGTTAGTTTCATTTCTTCAGC<br>TCCTTCCTCCAACTCATGTTCTGTAGGGACTTCTGGGACTAAGAACAGGACCCACATATGAGC<br>AACAGGATTTTCAGAGCAAGGCTGTGGTTGGAAGGGCTCAGACCAACGTCCACAGCAGAGT<br>GGAGGTCTAGTATAAAGAATGTGAAGTTTGTAGCATCTCTTGATCCCGCTATTCCTACATGCTTG |
| 686 | UGT1A8 | 2533073 | GCCTAATGTCTGCCTGCTCAAGAAGGTGGACCTGAGCTCTGTTCCCTTTGCAACCTTCCTGGA<br>GTCTTATTGCTATCTAGATGAACTCAAAGCAAGATGCTGCCGCCC |

TABLE 13-continued

Subtyping Target Sequences

| SEQ ID NO. | Gene | Affy Probeset ID | Sequence |
|---|---|---|---|
| 687 | UGT1A10 | 2533073 | GCCTAATGTCTGCCTGCTCAAGAAGGTGGACCTGAGCTCTGTTCCCTTTGCAACCTTCCTGGA<br>GTCTTATTGCTATCTAGATGAACTCAAAGCAAGATGCTGCCGCCC |
| 688 | UGT1A9 | 2533073 | GCCTAATGTCTGCCTGCTCAAGAAGGTGGACCTGAGCTCTGTTCCCTTTGCAACCTTCCTGGA<br>GTCTTATTGCTATCTAGATGAACTCAAAGCAAGATGCTGCCGCCC |
| 689 | UGT1A8 | 2533074 | GCTGAGTCTTCGCATGCCTTGAACAATGAATTTGCATCCTGGTTATGTTCCCCATGGGGGCCA<br>GCCCTGTCCTTGGAGTGGCCCCTCTAATCATGTTGCTCAGGCTTCTTCTCCCTTCCTGGGCCCC<br>AGAACACCTCCGGTGCCAAACTTGTGGGTGGGAACAGGAACTCGCGTGCCAGCCAGGTGTG<br>CATGACTAGCTCTGGGCAAGTCTGTTCTAGTAATTCAAGGTACCACCTCTCACTGGGACAGCC<br>TAGTTTCTACACAGGTCTTGCTCTGGGACCGCCCTCAGCAGTGTGGTTAGCAGGCAGGGCCA<br>GTGTGACCCTCCCTTTCTGGGCCTCAGTTGAGAAACCTGAAGCTCAGGAGAGGAGTCACTCCC<br>CTGGCAGATGGGTGGCTGGGCCAGAAGCAGATACCAGGCTTTCTGACTCCTGCTCTAGGATT<br>CTCACCACGTACTG |
| 690 | UGT1A10 | 2533074 | GCTGAGTCTTCGCATGCCTTGAACAATGAATTTGCATCCTGGTTATGTTCCCCATGGGGGCCA<br>GCCCTGTCCTTGGAGTGGCCCCTCTAATCATGTTGCTCAGGCTTCTTCTCCCTTCCTGGGCCCC<br>AGAACACCTCCGGTGCCAAACTTGTGGGTGGGAACAGGAACTCGCGTGCCAGCCAGGTGTG<br>CATGACTAGCTCTGGGCAAGTCTGTTCTAGTAATTCAAGGTACCACCTCTCACTGGGACAGCC<br>TAGTTTCTACACAGGTCTTGCTCTGGGACCGCCCTCAGCAGTGTGGTTAGCAGGCAGGGCCA<br>GTGTGACCCTCCCTTTCTGGGCCTCAGTTGAGAAACCTGAAGCTCAGGAGAGGAGTCACTCCC<br>CTGGCAGATGGGTGGCTGGGCCAGAAGCAGATACCAGGCTTTCTGACTCCTGCTCTAGGATT<br>CTCACCACGTACTG |
| 691 | UGT1A9 | 2533074 | GCTGAGTCTTCGCATGCCTTGAACAATGAATTTGCATCCTGGTTATGTTCCCCATGGGGGCCA<br>GCCCTGTCCTTGGAGTGGCCCCTCTAATCATGTTGCTCAGGCTTCTTCTCCCTTCCTGGGCCCC<br>AGAACACCTCCGGTGCCAAACTTGTGGGTGGGAACAGGAACTCGCGTGCCAGCCAGGTGTG<br>CATGACTAGCTCTGGGCAAGTCTGTTCTAGTAATTCAAGGTACCACCTCTCACTGGGACAGCC<br>TAGTTTCTACACAGGTCTTGCTCTGGGACCGCCCTCAGCAGTGTGGTTAGCAGGCAGGGCCA<br>GTGTGACCCTCCCTTTCTGGGCCTCAGTTGAGAAACCTGAAGCTCAGGAGAGGAGTCACTCCC<br>CTGGCAGATGGGTGGCTGGGCCAGAAGCAGATACCAGGCTTTCTGACTCCTGCTCTAGGATT<br>CTCACCACGTACTG |
| 692 | UGT1A8 | 2533075 | TCTCTAAGGATGAGGGCTAGTTGCCAGGGAACAAAACCCTTGCGATTAGAGGGAAGAAAGG<br>AGAGAGAGATTGAAGATTGATTTGATCACCGATGGGCAACAATCTAATCAATCATGCCTACTA<br>TGTATGGAAGCCTACATAAAAACTCAGAAGGGCAGGGTTCAGAGAGCTTTCAGGTTGCTGAA<br>GGTGTGGAGGGTGGGGCACCCAGAGATGGCAGATGGGGCTCCATGGCCATACCCCCATATC<br>TTGTTCTTTGTACTTTTTCCTCTGGCTATTCATCCGTATTGTTTG |
| 693 | UGT1A10 | 2533075 | TCTCTAAGGATGAGGGCTAGTTGCCAGGGAACAAAACCCTTGCGATTAGAGGGAAGAAAGG<br>AGAGAGAGATTGAAGATTGATTTGATCACCGATGGGCAACAATCTAATCAATCATGCCTACTA<br>TGTATGGAAGCCTACATAAAAACTCAGAAGGGCAGGGTTCAGAGAGCTTTCAGGTTGCTGAA<br>GGTGTGGAGGGTGGGGCACCCAGAGATGGCAGATGGGGCTCCATGGCCATACCCCCATATC<br>TTGTTCTTTGTACTTTTTCCTCTGGCTATTCATCCGTATTGTTTG |
| 694 | UGT1A9 | 2533075 | TCTCTAAGGATGAGGGCTAGTTGCCAGGGAACAAAACCCTTGCGATTAGAGGGAAGAAAGG<br>AGAGAGAGATTGAAGATTGATTTGATCACCGATGGGCAACAATCTAATCAATCATGCCTACTA<br>TGTATGGAAGCCTACATAAAAACTCAGAAGGGCAGGGTTCAGAGAGCTTTCAGGTTGCTGAA<br>GGTGTGGAGGGTGGGGCACCCAGAGATGGCAGATGGGGCTCCATGGCCATACCCCCATATC<br>TTGTTCTTTGTACTTTTTCCTCTGGCTATTCATCCGTATTGTTTG |
| 695 | UGT1A8 | 2533077 | TGAAAAGCAGTGGTTAGTTTAGGGAAAATACCTAGGAGCCCTGTGATTTGGAGAGTGAAAAC<br>TCTTTATTACC |
| 696 | UGT1A10 | 2533077 | TGAAAAGCAGTGGTTAGTTTAGGGAAAATACCTAGGAGCCCTGTGATTTGGAGAGTGAAAAC<br>TCTTTATTACC |
| 697 | UGT1A9 | 2533077 | TGAAAAGCAGTGGTTAGTTTAGGGAAAATACCTAGGAGCCCTGTGATTTGGAGAGTGAAAAC<br>TCTTTATTACC |
| 698 | UGT1A8 | 2533078 | ATGGCCTGCCTCCTTCGCTCATTTCAG |
| 699 | UGT1A10 | 2533078 | ATGGCCTGCCTCCTTCGCTCATTTCAG |
| 700 | UGT1A9 | 2533078 | ATGGCCTGCCTCCTTCGCTCATTTCAG |
| 701 | UGT1A8 | 2533079 | AGAATTTCTGCAGGGGTTTTCTTCTTAGCACTTTG |
| 702 | UGT1A10 | 2533079 | AGAATTTCTGCAGGGGTTTTCTTCTTAGCACTTTG |
| 703 | UGT1A9 | 2533079 | AGAATTTCTGCAGGGGTTTTCTTCTTAGCACTTTG |
| 704 | UGT1A8 | 2533080 | TCCCTCAGGACGGAAGCCACTGGCTTAGTATGAAGGATATAGTTGAGGTTCTCAGTGACCGG<br>GGTCATGAGATTGTAGTGGTGGTGCCTGAAGTTAATTTGCTTTTGAAAGAATCCAAATACTAC |

TABLE 13-continued

Subtyping Target Sequences

| SEQ ID NO. | Gene | Affy Probeset ID | Sequence |
|---|---|---|---|
| | | | ACAAGAAAAATCTATCCAGTGCCGTATGACCAAGAAGAGCTGAAGAACCGTTACCAATCATTT GGAAACAATCACTTTGCTGAGCGATCATTCCTAACTGCTCCTCAGACAGAGTACAGGAATAAC ATGATTGTTATTGGCCTGTACTTCATCAACTGCCAGAGCCTCCTGCAGGACAGGGACACCCTG AACTTCTTTAAGGAGAGCAAGTTTGATGCTCTTTTCACAGACCCAGCCTTACCCTGTGGGGTG ATCCTGGCTGAGTATTGGGCCTACCATCTGTGTACCTCTTCAGGGGTTTTCCGTGTTCCCTGG AGCATACATTCAGCAGAAGCCCAGACCCTGTGTCCTACATTCCCAGGTGCTACACAAAGTTTT CAGACCACATGACTTTTTCCCAACGAGTGGCCAACTTCCTTGTTAATTTGTTGGAGCCCTATCT ATTTTATTGTCTGTTTTCAAAGTATGAAGAACTCGCATCAGCTGTCCTCAAGA |
| 705 | UGT1A10 | 2533080 | TCCCTCAGGACGGAAGCCACTGGCTTAGTATGAAGGATATAGTTGAGGTTCTCAGTGACCGG GGTCATGAGATTGTAGTGGTGGTGCCTGAAGTTAATTTGCTTTTGAAAGAATCCAAATACTAC ACAAGAAAAATCTATCCAGTGCCGTATGACCAAGAAGAGCTGAAGAACCGTTACCAATCATTT GGAAACAATCACTTTGCTGAGCGATCATTCCTAACTGCTCCTCAGACAGAGTACAGGAATAAC ATGATTGTTATTGGCCTGTACTTCATCAACTGCCAGAGCCTCCTGCAGGACAGGGACACCCTG AACTTCTTTAAGGAGAGCAAGTTTGATGCTCTTTTCACAGACCCAGCCTTACCCTGTGGGGTG ATCCTGGCTGAGTATTGGGCCTACCATCTGTGTACCTCTTCAGGGGTTTTCCGTGTTCCCTGG AGCATACATTCAGCAGAAGCCCAGACCCTGTGTCCTACATTCCCAGGTGCTACACAAAGTTTT CAGACCACATGACTTTTTCCCAACGAGTGGCCAACTTCCTTGTTAATTTGTTGGAGCCCTATCT ATTTTATTGTCTGTTTTCAAAGTATGAAGAACTCGCATCAGCTGTCCTCAAGA |
| 706 | UGT1A9 | 2533080 | TCCCTCAGGACGGAAGCCACTGGCTTAGTATGAAGGATATAGTTGAGGTTCTCAGTGACCGG GGTCATGAGATTGTAGTGGTGGTGCCTGAAGTTAATTTGCTTTTGAAAGAATCCAAATACTAC ACAAGAAAAATCTATCCAGTGCCGTATGACCAAGAAGAGCTGAAGAACCGTTACCAATCATTT GGAAACAATCACTTTGCTGAGCGATCATTCCTAACTGCTCCTCAGACAGAGTACAGGAATAAC ATGATTGTTATTGGCCTGTACTTCATCAACTGCCAGAGCCTCCTGCAGGACAGGGACACCCTG AACTTCTTTAAGGAGAGCAAGTTTGATGCTCTTTTCACAGACCCAGCCTTACCCTGTGGGGTG ATCCTGGCTGAGTATTGGGCCTACCATCTGTGTACCTCTTCAGGGGTTTTCCGTGTTCCCTGG AGCATACATTCAGCAGAAGCCCAGACCCTGTGTCCTACATTCCCAGGTGCTACACAAAGTTTT CAGACCACATGACTTTTTCCCAACGAGTGGCCAACTTCCTTGTTAATTTGTTGGAGCCCTATCT ATTTTATTGTCTGTTTTCAAAGTATGAAGAACTCGCATCAGCTGTCCTCAAGA |
| 707 | UGT1A8 | 2533081 | GTCTTCATTGGAGGTATCAACTGTAAGAAGAGGAAAG |
| 708 | UGT1A10 | 2533081 | GTCTTCATTGGAGGTATCAACTGTAAGAAGAGGAAAG |
| 709 | UGT1A9 | 2533081 | GTCTTCATTGGAGGTATCAACTGTAAGAAGAGGAAAG |
| 710 | UGT1A8 | 2533085 | ACAGGACTCCAGGTTCCCCTGCCGCAG |
| 711 | UGT1A10 | 2533085 | ACAGGACTCCAGGTTCCCCTGCCGCAG |
| 712 | UGT1A9 | 2533085 | ACAGGACTCCAGGTTCCCCTGCCGCAG |
| 713 | UGT1A5 | 2533085 | ACAGGACTCCAGGTTCCCCTGCCGCAG |
| 714 | UGT1A8 | 2533086 | AGGTGCTGGTGGTGCCCACTGATGG |
| 715 | UGT1A10 | 2533086 | AGGTGCTGGTGGTGCCCACTGATGG |
| 716 | UGT1A9 | 2533086 | AGGTGCTGGTGGTGCCCACTGATGG |
| 717 | UGT1A5 | 2533086 | AGGTGCTGGTGGTGCCCACTGATGG |
| 718 | UGT1A8 | 2533087 | ACCTCCATGCGAGAGGCCACCAGGTG |
| 719 | UGT1A10 | 2533087 | ACCTCCATGCGAGAGGCCACCAGGTG |
| 720 | UGT1A9 | 2533087 | ACCTCCATGCGAGAGGCCACCAGGTG |
| 721 | UGT1A5 | 2533087 | ACCTCCATGCGAGAGGCCACCAGGTG |
| 722 | UGT1A8 | 2533088 | GCTGGGTCACACTCAATCGTTCTTTGAAACAGAACATCTTCTGATGAAATTTTCTAGAAGAAT GGCAATTATGAACAATATGTCTTTGATCATACATAGGTCTTGTGTGGAGC |
| 723 | UGT1A10 | 2533088 | GCTGGGTCACACTCAATCGTTCTTTGAAACAGAACATCTTCTGATGAAATTTTCTAGAAGAAT GGCAATTATGAACAATATGTCTTTGATCATACATAGGTCTTGTGTGGAGC |
| 724 | UGT1A9 | 2533088 | GCTGGGTCACACTCAATCGTTCTTTGAAACAGAACATCTTCTGATGAAATTTTCTAGAAGAAT GGCAATTATGAACAATATGTCTTTGATCATACATAGGTCTTGTGTGGAGC |
| 725 | UGT1A5 | 2533088 | GCTGGGTCACACTCAATCGTTCTTTGAAACAGAACATCTTCTGATGAAATTTTCTAGAAGAAT GGCAATTATGAACAATATGTCTTTGATCATACATAGGTCTTGTGTGGAGC |

TABLE 13-continued

Subtyping Target Sequences

| SEQ ID NO. | Gene | Affy Probeset ID | Sequence |
|---|---|---|---|
| 726 | UGT1A8 | 2533089 | GTGCTGGCTAAGTACCTGTCGATTCCTGCTGTGTTTTCTTGAGGAACATTCCATGTGATTTAGACTTTAAGGGCACACAGTGTCCAAACCCTTCCTCCTATATTCCTAGATTACTAACGACCAATTCAGACCACATGACATTCCTGCAAAGGGTCAAGAACA |
| 727 | UGT1A10 | 2533089 | GTGCTGGCTAAGTACCTGTCGATTCCTGCTGTGTTTTCTTGAGGAACATTCCATGTGATTTAGACTTTAAGGGCACACAGTGTCCAAACCCTTCCTCCTATATTCCTAGATTACTAACGACCAATTCAGACCACATGACATTCCTGCAAAGGGTCAAGAACA |
| 728 | UGT1A9 | 2533089 | GTGCTGGCTAAGTACCTGTCGATTCCTGCTGTGTTTTCTTGAGGAACATTCCATGTGATTTAGACTTTAAGGGCACACAGTGTCCAAACCCTTCCTCCTATATTCCTAGATTACTAACGACCAATTCAGACCACATGACATTCCTGCAAAGGGTCAAGAACA |
| 729 | UGT1A5 | 2533089 | GTGCTGGCTAAGTACCTGTCGATTCCTGCTGTGTTTTCTTGAGGAACATTCCATGTGATTTAGACTTTAAGGGCACACAGTGTCCAAACCCTTCCTCCTATATTCCTAGATTACTAACGACCAATTCAGACCACATGACATTCCTGCAAAGGGTCAAGAACA |
| 730 | UGT1A8 | 2533092 | TGGATGAATGGATACTTCAGTCTCTATGCAGACTTGCAGAAGACTGGAGCCTTTGGCATTCAGAAGAGGAATTCAG |
| 731 | UGT1A10 | 2533092 | TGGATGAATGGATACTTCAGTCTCTATGCAGACTTGCAGAAGACTGGAGCCTTTGGCATTCAGAAGAGGAATTCAG |
| 732 | UGT1A9 | 2533092 | TGGATGAATGGATACTTCAGTCTCTATGCAGACTTGCAGAAGACTGGAGCCTTTGGCATTCAGAAGAGGAATTCAG |
| 733 | UGT1A5 | 2533092 | TGGATGAATGGATACTTCAGTCTCTATGCAGACTTGCAGAAGACTGGAGCCTTTGGCATTCAGAAGAGGAATTCAG |
| 734 | UGT1A8 | 2533094 | ATGGCCAGAGGACTCCAGGTTCCCCTGCCGC |
| 735 | UGT1A10 | 2533094 | ATGGCCAGAGGACTCCAGGTTCCCCTGCCGC |
| 736 | UGT1A9 | 2533094 | ATGGCCAGAGGACTCCAGGTTCCCCTGCCGC |
| 737 | UGT1A5 | 2533094 | ATGGCCAGAGGACTCCAGGTTCCCCTGCCGC |
| 738 | UGT1A4 | 2533094 | ATGGCCAGAGGACTCCAGGTTCCCCTGCCGC |
| 739 | UGT1A8 | 2533095 | GACTGCTGCTCCTCCTCAGTGTCCAG |
| 740 | UGT1A10 | 2533095 | GACTGCTGCTCCTCCTCAGTGTCCAG |
| 741 | UGT1A9 | 2533095 | GACTGCTGCTCCTCCTCAGTGTCCAG |
| 742 | UGT1A5 | 2533095 | GACTGCTGCTCCTCCTCAGTGTCCAG |
| 743 | UGT1A4 | 2533095 | GACTGCTGCTCCTCCTCAGTGTCCAG |
| 744 | UGT1A8 | 2533096 | GAGAGTGGAAAGGTGTTGGTGGTGCCCACTGATGGCAGCCCCTGGCTCAGCATGCGGGAGGCCTTGCGGGAGCTCCATGCCAGAGGCCACCAGGCGGTGGTCCTCACCCCAGAG |
| 745 | UGT1A10 | 2533096 | GAGAGTGGAAAGGTGTTGGTGGTGCCCACTGATGGCAGCCCCTGGCTCAGCATGCGGGAGGCCTTGCGGGAGCTCCATGCCAGAGGCCACCAGGCGGTGGTCCTCACCCCAGAG |
| 746 | UGT1A9 | 2533096 | GAGAGTGGAAAGGTGTTGGTGGTGCCCACTGATGGCAGCCCCTGGCTCAGCATGCGGGAGGCCTTGCGGGAGCTCCATGCCAGAGGCCACCAGGCGGTGGTCCTCACCCCAGAG |
| 747 | UGT1A5 | 2533096 | GAGAGTGGAAAGGTGTTGGTGGTGCCCACTGATGGCAGCCCCTGGCTCAGCATGCGGGAGGCCTTGCGGGAGCTCCATGCCAGAGGCCACCAGGCGGTGGTCCTCACCCCAGAG |
| 748 | UGT1A4 | 2533096 | GAGAGTGGAAAGGTGTTGGTGGTGCCCACTGATGGCAGCCCCTGGCTCAGCATGCGGGAGGCCTTGCGGGAGCTCCATGCCAGAGGCCACCAGGCGGTGGTCCTCACCCCAGAG |
| 749 | UGT1A8 | 2533097 | GCCTATGCTGTTCCATGGACCCAGAAGGAATTTGATCGCGTTACGCTGGGCTACACTCAAGGGTTCTTTGAAACAGAACATCTTCTGAAGAGATATTCTAGAAGTATGGCAATTATGAACAATGTATCTTTGGCCCTTCATAGG |
| 750 | UGT1A10 | 2533097 | GCCTATGCTGTTCCATGGACCCAGAAGGAATTTGATCGCGTTACGCTGGGCTACACTCAAGGGTTCTTTGAAACAGAACATCTTCTGAAGAGATATTCTAGAAGTATGGCAATTATGAACAATGTATCTTTGGCCCTTCATAGG |
| 751 | UGT1A9 | 2533097 | GCCTATGCTGTTCCATGGACCCAGAAGGAATTTGATCGCGTTACGCTGGGCTACACTCAAGGGTTCTTTGAAACAGAACATCTTCTGAAGAGATATTCTAGAAGTATGGCAATTATGAACAATGTATCTTTGGCCCTTCATAGG |

TABLE 13-continued

Subtyping Target Sequences

| SEQ ID NO. | Gene | Affy Probeset ID | Sequence |
|---|---|---|---|
| 752 | UGT1A5 | 2533097 | GCCTATGCTGTTCCATGGACCCAGAAGGAATTTGATCGCGTTACGCTGGGCTACACTCAAGG<br>GTTCTTTGAAACAGAACATCTTCTGAAGAGATATTCTAGAAGTATGGCAATTATGAACAATGT<br>ATCTTTGGCCCTTCATAGG |
| 753 | UGT1A4 | 2533097 | GCCTATGCTGTTCCATGGACCCAGAAGGAATTTGATCGCGTTACGCTGGGCTACACTCAAGG<br>GTTCTTTGAAACAGAACATCTTCTGAAGAGATATTCTAGAAGTATGGCAATTATGAACAATGT<br>ATCTTTGGCCCTTCATAGG |
| 754 | UGT1A8 | 2533101 | TTGGTGGTGCCCATTGATGGCAGCCACTGGCTCAGCATGCGGGAGGTCTTGCGGGAGCTCCA<br>TGCCAGA |
| 755 | UGT1A10 | 2533101 | TTGGTGGTGCCCATTGATGGCAGCCACTGGCTCAGCATGCGGGAGGTCTTGCGGGAGCTCCA<br>TGCCAGA |
| 756 | UGT1A9 | 2533101 | TTGGTGGTGCCCATTGATGGCAGCCACTGGCTCAGCATGCGGGAGGTCTTGCGGGAGCTCCA<br>TGCCAGA |
| 757 | UGT1A5 | 2533101 | TTGGTGGTGCCCATTGATGGCAGCCACTGGCTCAGCATGCGGGAGGTCTTGCGGGAGCTCCA<br>TGCCAGA |
| 758 | UGT1A4 | 2533101 | TTGGTGGTGCCCATTGATGGCAGCCACTGGCTCAGCATGCGGGAGGTCTTGCGGGAGCTCCA<br>TGCCAGA |
| 759 | UGT1A3 | 2533101 | TTGGTGGTGCCCATTGATGGCAGCCACTGGCTCAGCATGCGGGAGGTCTTGCGGGAGCTCCA<br>TGCCAGA |
| 760 | UGT1A8 | 2533102 | CTATCATAGGTCTTGTGTGGAGCTACTACATAATGAGGCCCTGATCAGGCACCTGAATGCTAC<br>TTCCTTTGATGTGGTTTTAACAGACCCCGTTAACCTCTGCGCGGCAGTGCTGGCTAAGTACCTG<br>TCGATTCCTACTGTGTTTTTTTTGAGGAACATTCCATGTGATTTAGACTTTAAGGGCACACAGT<br>GTCCAAACCCTTCCTCCTATATTCCTAGATTACTAACAACCAATTCAGACCACATGACATTCAT<br>GCAAAGGGTCAAGAACATGCTCTACCCTCTGGCCCTGTCCTACATTTGCCATGCTTTTTCTGCT<br>CCTTATGCAAGC |
| 761 | UGT1A10 | 2533102 | CTATCATAGGTCTTGTGTGGAGCTACTACATAATGAGGCCCTGATCAGGCACCTGAATGCTAC<br>TTCCTTTGATGTGGTTTTAACAGACCCCGTTAACCTCTGCGCGGCAGTGCTGGCTAAGTACCTG<br>TCGATTCCTACTGTGTTTTTTTTGAGGAACATTCCATGTGATTTAGACTTTAAGGGCACACAGT<br>GTCCAAACCCTTCCTCCTATATTCCTAGATTACTAACAACCAATTCAGACCACATGACATTCAT<br>GCAAAGGGTCAAGAACATGCTCTACCCTCTGGCCCTGTCCTACATTTGCCATGCTTTTTCTGCT<br>CCTTATGCAAGC |
| 762 | UGT1A9 | 2533102 | CTATCATAGGTCTTGTGTGGAGCTACTACATAATGAGGCCCTGATCAGGCACCTGAATGCTAC<br>TTCCTTTGATGTGGTTTTAACAGACCCCGTTAACCTCTGCGCGGCAGTGCTGGCTAAGTACCTG<br>TCGATTCCTACTGTGTTTTTTTTGAGGAACATTCCATGTGATTTAGACTTTAAGGGCACACAGT<br>GTCCAAACCCTTCCTCCTATATTCCTAGATTACTAACAACCAATTCAGACCACATGACATTCAT<br>GCAAAGGGTCAAGAACATGCTCTACCCTCTGGCCCTGTCCTACATTTGCCATGCTTTTTCTGCT<br>CCTTATGCAAGC |
| 763 | UGT1A5 | 2533102 | CTATCATAGGTCTTGTGTGGAGCTACTACATAATGAGGCCCTGATCAGGCACCTGAATGCTAC<br>TTCCTTTGATGTGGTTTTAACAGACCCCGTTAACCTCTGCGCGGCAGTGCTGGCTAAGTACCTG<br>TCGATTCCTACTGTGTTTTTTTTGAGGAACATTCCATGTGATTTAGACTTTAAGGGCACACAGT<br>GTCCAAACCCTTCCTCCTATATTCCTAGATTACTAACAACCAATTCAGACCACATGACATTCAT<br>GCAAAGGGTCAAGAACATGCTCTACCCTCTGGCCCTGTCCTACATTTGCCATGCTTTTTCTGCT<br>CCTTATGCAAGC |
| 764 | UGT1A4 | 2533102 | CTATCATAGGTCTTGTGTGGAGCTACTACATAATGAGGCCCTGATCAGGCACCTGAATGCTAC<br>TTCCTTTGATGTGGTTTTAACAGACCCCGTTAACCTCTGCGCGGCAGTGCTGGCTAAGTACCTG<br>TCGATTCCTACTGTGTTTTTTTTGAGGAACATTCCATGTGATTTAGACTTTAAGGGCACACAGT<br>GTCCAAACCCTTCCTCCTATATTCCTAGATTACTAACAACCAATTCAGACCACATGACATTCAT<br>GCAAAGGGTCAAGAACATGCTCTACCCTCTGGCCCTGTCCTACATTTGCCATGCTTTTTCTGCT<br>CCTTATGCAAGC |
| 765 | UGT1A3 | 2533102 | CTATCATAGGTCTTGTGTGGAGCTACTACATAATGAGGCCCTGATCAGGCACCTGAATGCTAC<br>TTCCTTTGATGTGGTTTTAACAGACCCCGTTAACCTCTGCGCGGCAGTGCTGGCTAAGTACCTG<br>TCGATTCCTACTGTGTTTTTTTTGAGGAACATTCCATGTGATTTAGACTTTAAGGGCACACAGT<br>GTCCAAACCCTTCCTCCTATATTCCTAGATTACTAACAACCAATTCAGACCACATGACATTCAT<br>GCAAAGGGTCAAGAACATGCTCTACCCTCTGGCCCTGTCCTACATTTGCCATGCTTTTTCTGCT<br>CCTTATGCAAGC |
| 766 | UGT1A8 | 2533103 | TTCCGAGGGGACTTTGTGATGGACT |
| 767 | UGT1A10 | 2533103 | TTCCGAGGGGACTTTGTGATGGACT |
| 768 | UGT1A9 | 2533103 | TTCCGAGGGGACTTTGTGATGGACT |

TABLE 13-continued

Subtyping Target Sequences

| SEQ ID NO. | Gene | Affy Probeset ID | Sequence |
|---|---|---|---|
| 769 | UGT1A5 | 2533103 | TTCCGAGGGGACTTTGTGATGGACT |
| 770 | UGT1A4 | 2533103 | TTCCGAGGGGACTTTGTGATGGACT |
| 771 | UGT1A8 | 2533104 | GCCCAACATGGTCTTCATTGGGGGC |
| 772 | UGT1A10 | 2533104 | GCCCAACATGGTCTTCATTGGGGGC |
| 773 | UGT1A9 | 2533104 | GCCCAACATGGTCTTCATTGGGGGC |
| 774 | UGT1A5 | 2533104 | GCCCAACATGGTCTTCATTGGGGGC |
| 775 | UGT1A8 | 2533108 | AGGACCCCAGGTTCCCCTGCTGTGGCTGGCCACAG |
| 776 | UGT1A10 | 2533108 | AGGACCCCAGGTTCCCCTGCTGTGGCTGGCCACAG |
| 777 | UGT1A9 | 2533108 | AGGACCCCAGGTTCCCCTGCTGTGGCTGGCCACAG |
| 778 | UGT1A5 | 2533108 | AGGACCCCAGGTTCCCCTGCTGTGGCTGGCCACAG |
| 779 | UGT1A4 | 2533108 | AGGACCCCAGGTTCCCCTGCTGTGGCTGGCCACAG |
| 780 | UGT1A3 | 2533108 | AGGACCCCAGGTTCCCCTGCTGTGGCTGGCCACAG |
| 781 | UGT1A8 | 2533109 | GAGTGCTACTCCTTCTCAGTGCCCAGCCCTG |
| 782 | UGT1A10 | 2533109 | GAGTGCTACTCCTTCTCAGTGCCCAGCCCTG |
| 783 | UGT1A9 | 2533109 | GAGTGCTACTCCTTCTCAGTGCCCAGCCCTG |
| 784 | UGT1A5 | 2533109 | GAGTGCTACTCCTTCTCAGTGCCCAGCCCTG |
| 785 | UGT1A4 | 2533109 | GAGTGCTACTCCTTCTCAGTGCCCAGCCCTG |
| 786 | UGT1A3 | 2533109 | GAGTGCTACTCCTTCTCAGTGCCCAGCCCTG |
| 787 | UGT1A8 | 2533110 | AGAGGCCACCAGGCGGTGGTCCTCACCCCAGAG |
| 788 | UGT1A10 | 2533110 | AGAGGCCACCAGGCGGTGGTCCTCACCCCAGAG |
| 789 | UGT1A9 | 2533110 | AGAGGCCACCAGGCGGTGGTCCTCACCCCAGAG |
| 790 | UGT1A5 | 2533110 | AGAGGCCACCAGGCGGTGGTCCTCACCCCAGAG |
| 791 | UGT1A4 | 2533110 | AGAGGCCACCAGGCGGTGGTCCTCACCCCAGAG |
| 792 | UGT1A8 | 2533111 | CCTTGTGCTGGGCCACACTCAACTGTACTTTGAAACAGAACATTTTCTGAAGACATTTTCTAAA AGTATGGCAATTTTGAAAAATTCATCTTTGGTCTTTCATAGGTCTTGTGTGGAGCTACTGCATA ATGAGGCCCTGATCAGGCACCTGAATGCTACTTCCTTCGATGTGGTTTTAATAGACCCAATTTA CCTCTGTGGGGCAGTG |
| 793 | UGT1A10 | 2533111 | CCTTGTGCTGGGCCACACTCAACTGTACTTTGAAACAGAACATTTTCTGAAGACATTTTCTAAA AGTATGGCAATTTTGAAAAATTCATCTTTGGTCTTTCATAGGTCTTGTGTGGAGCTACTGCATA ATGAGGCCCTGATCAGGCACCTGAATGCTACTTCCTTCGATGTGGTTTTAATAGACCCAATTTA CCTCTGTGGGGCAGTG |
| 794 | UGT1A9 | 2533111 | CCTTGTGCTGGGCCACACTCAACTGTACTTTGAAACAGAACATTTTCTGAAGACATTTTCTAAA AGTATGGCAATTTTGAAAAATTCATCTTTGGTCTTTCATAGGTCTTGTGTGGAGCTACTGCATA ATGAGGCCCTGATCAGGCACCTGAATGCTACTTCCTTCGATGTGGTTTTAATAGACCCAATTTA CCTCTGTGGGGCAGTG |
| 795 | UGT1A5 | 2533111 | CCTTGTGCTGGGCCACACTCAACTGTACTTTGAAACAGAACATTTTCTGAAGACATTTTCTAAA AGTATGGCAATTTTGAAAAATTCATCTTTGGTCTTTCATAGGTCTTGTGTGGAGCTACTGCATA ATGAGGCCCTGATCAGGCACCTGAATGCTACTTCCTTCGATGTGGTTTTAATAGACCCAATTTA CCTCTGTGGGGCAGTG |
| 796 | UGT1A4 | 2533111 | CCTTGTGCTGGGCCACACTCAACTGTACTTTGAAACAGAACATTTTCTGAAGACATTTTCTAAA AGTATGGCAATTTTGAAAAATTCATCTTTGGTCTTTCATAGGTCTTGTGTGGAGCTACTGCATA ATGAGGCCCTGATCAGGCACCTGAATGCTACTTCCTTCGATGTGGTTTTAATAGACCCAATTTA CCTCTGTGGGGCAGTG |
| 797 | UGT1A3 | 2533111 | CCTTGTGCTGGGCCACACTCAACTGTACTTTGAAACAGAACATTTTCTGAAGACATTTTCTAAA AGTATGGCAATTTTGAAAAATTCATCTTTGGTCTTTCATAGGTCTTGTGTGGAGCTACTGCATA |

TABLE 13-continued

Subtyping Target Sequences

| SEQ ID NO. | Gene | Affy Probeset ID | Sequence |
|---|---|---|---|
| | | | ATGAGGCCCTGATCAGGCACCTGAATGCTACTTCCTTCGATGTGGTTTTAATAGACCCAATTTACCTCTGTGGGGCAGTG |
| 798 | UGT1A8 | 2533112 | TCCGAGGGGACTTTGTGATGGATTACCCCAGGCCGATCATGCCCAACATGGTCTTCATTGGGGGC |
| 799 | UGT1A10 | 2533112 | TCCGAGGGGACTTTGTGATGGATTACCCCAGGCCGATCATGCCCAACATGGTCTTCATTGGGGGC |
| 800 | UGT1A9 | 2533112 | TCCGAGGGGACTTTGTGATGGATTACCCCAGGCCGATCATGCCCAACATGGTCTTCATTGGGGGC |
| 801 | UGT1A5 | 2533112 | TCCGAGGGGACTTTGTGATGGATTACCCCAGGCCGATCATGCCCAACATGGTCTTCATTGGGGGC |
| 802 | UGT1A8 | 2533116 | TCCTCTGACCCCCCAAAATATTCTCCAG |
| 803 | UGT1A10 | 2533116 | TCCTCTGACCCCCCAAAATATTCTCCAG |
| 804 | UGT1A9 | 2533116 | TCCTCTGACCCCCCAAAATATTCTCCAG |
| 805 | UGT1A5 | 2533116 | TCCTCTGACCCCCCAAAATATTCTCCAG |
| 806 | UGT1A4 | 2533116 | TCCTCTGACCCCCCAAAATATTCTCCAG |
| 807 | UGT1A3 | 2533116 | TCCTCTGACCCCCCAAAATATTCTCCAG |
| 808 | UGT1A8 | 2533117 | CGGCCGCCAAAGAACTCCCTGAAGACCTCGGCGGGGTCACGGAAGCTGAAGACCTACTCGAAGGGGTCCTTGAAGGGCCTGCCGCCTGCGCAGCCGCCCTCCGCCCTCGCCTCGCCATAGCGGTCATAGATATCGCGTTTCTACGCGTCCGACAACACCTCGTAGGCCTCAGCCACCTGCTTGAATCTTCTCACCGCTTCCTCCCTGTCCTCGGGGTTTTTGTCGGGGTGCCACTTGAGCGCCAGCTTGCGGTACGCCTTCTTGATACCCTCGGACGAGGCCTACCGGGGTACTCCCAGCACCTCGTAGTAGTCCACTATG |
| 809 | UGT1A10 | 2533117 | CGGCCGCCAAAGAACTCCCTGAAGACCTCGGCGGGGTCACGGAAGCTGAAGACCTACTCGAAGGGGTCCTTGAAGGGCCTGCCGCCTGCGCAGCCGCCCTCCGCCCTCGCCTCGCCATAGCGGTCATAGATATCGCGTTTCTACGCGTCCGACAACACCTCGTAGGCCTCAGCCACCTGCTTGAATCTTCTCACCGCTTCCTCCCTGTCCTCGGGGTTTTTGTCGGGGTGCCACTTGAGCGCCAGCTTGCGGTACGCCTTCTTGATACCCTCGGACGAGGCCTACCGGGGTACTCCCAGCACCTCGTAGTAGTCCACTATG |
| 810 | UGT1A9 | 2533117 | CGGCCGCCAAAGAACTCCCTGAAGACCTCGGCGGGGTCACGGAAGCTGAAGACCTACTCGAAGGGGTCCTTGAAGGGCCTGCCGCCTGCGCAGCCGCCCTCCGCCCTCGCCTCGCCATAGCGGTCATAGATATCGCGTTTCTACGCGTCCGACAACACCTCGTAGGCCTCAGCCACCTGCTTGAATCTTCTCACCGCTTCCTCCCTGTCCTCGGGGTTTTTGTCGGGGTGCCACTTGAGCGCCAGCTTGCGGTACGCCTTCTTGATACCCTCGGACGAGGCCTACCGGGGTACTCCCAGCACCTCGTAGTAGTCCACTATG |
| 811 | UGT1A5 | 2533117 | CGGCCGCCAAAGAACTCCCTGAAGACCTCGGCGGGGTCACGGAAGCTGAAGACCTACTCGAAGGGGTCCTTGAAGGGCCTGCCGCCTGCGCAGCCGCCCTCCGCCCTCGCCTCGCCATAGCGGTCATAGATATCGCGTTTCTACGCGTCCGACAACACCTCGTAGGCCTCAGCCACCTGCTTGAATCTTCTCACCGCTTCCTCCCTGTCCTCGGGGTTTTTGTCGGGGTGCCACTTGAGCGCCAGCTTGCGGTACGCCTTCTTGATACCCTCGGACGAGGCCTACCGGGGTACTCCCAGCACCTCGTAGTAGTCCACTATG |
| 812 | UGT1A4 | 2533117 | CGGCCGCCAAAGAACTCCCTGAAGACCTCGGCGGGGTCACGGAAGCTGAAGACCTACTCGAAGGGGTCCTTGAAGGGCCTGCCGCCTGCGCAGCCGCCCTCCGCCCTCGCCTCGCCATAGCGGTCATAGATATCGCGTTTCTACGCGTCCGACAACACCTCGTAGGCCTCAGCCACCTGCTTGAATCTTCTCACCGCTTCCTCCCTGTCCTCGGGGTTTTTGTCGGGGTGCCACTTGAGCGCCAGCTTGCGGTACGCCTTCTTGATACCCTCGGACGAGGCCTACCGGGGTACTCCCAGCACCTCGTAGTAGTCCACTATG |
| 813 | UGT1A3 | 2533117 | CGGCCGCCAAAGAACTCCCTGAAGACCTCGGCGGGGTCACGGAAGCTGAAGACCTACTCGAAGGGGTCCTTGAAGGGCCTGCCGCCTGCGCAGCCGCCCTCCGCCCTCGCCTCGCCATAGCGGTCATAGATATCGCGTTTCTACGCGTCCGACAACACCTCGTAGGCCTCAGCCACCTGCTTGAATCTTCTCACCGCTTCCTCCCTGTCCTCGGGGTTTTTGTCGGGGTGCCACTTGAGCGCCAGCTTGCGGTACGCCTTCTTGATACCCTCGGACGAGGCCTACCGGGGTACTCCCAGCACCTCGTAGTAGTCCACTATG |
| 814 | UGT1A8 | 2533118 | GTCTGACCGGGGCTGAAGACATCCTGTTGTTTAGGACTGCGGTTCTCCAACGTTCCAGC |
| 815 | UGT1A10 | 2533118 | GTCTGACCGGGGCTGAAGACATCCTGTTGTTTAGGACTGCGGTTCTCCAACGTTCCAGC |
| 816 | UGT1A9 | 2533118 | GTCTGACCGGGGCTGAAGACATCCTGTTGTTTAGGACTGCGGTTCTCCAACGTTCCAGC |

TABLE 13-continued

Subtyping Target Sequences

| SEQ ID NO. | Gene | Affy Probeset ID | Sequence |
|---|---|---|---|
| 817 | UGT1A5 | 2533118 | GTCTGACCGGGGCTGAAGACATCCTGTTGTTTAGGACTGCGGTTCTCCAACGTTCCAGC |
| 818 | UGT1A4 | 2533118 | GTCTGACCGGGGCTGAAGACATCCTGTTGTTTAGGACTGCGGTTCTCCAACGTTCCAGC |
| 819 | UGT1A3 | 2533118 | GTCTGACCGGGGCTGAAGACATCCTGTTGTTTAGGACTGCGGTTCTCCAACGTTCCAGC |
| 820 | UGT1A8 | 2533119 | AGTCCCAGGGCGGACGCCCACTTGTCCTGGGCCTGCTGCTGTGTGTGCTGGGCCCAGTGGTG<br>TCCCATGCTGGGAAGATACTGTTGATCCCAGTGGA |
| 821 | UGT1A10 | 2533119 | AGTCCCAGGGCGGACGCCCACTTGTCCTGGGCCTGCTGCTGTGTGTGCTGGGCCCAGTGGTG<br>TCCCATGCTGGGAAGATACTGTTGATCCCAGTGGA |
| 822 | UGT1A9 | 2533119 | AGTCCCAGGGCGGACGCCCACTTGTCCTGGGCCTGCTGCTGTGTGTGCTGGGCCCAGTGGTG<br>TCCCATGCTGGGAAGATACTGTTGATCCCAGTGGA |
| 823 | UGT1A5 | 2533119 | AGTCCCAGGGCGGACGCCCACTTGTCCTGGGCCTGCTGCTGTGTGTGCTGGGCCCAGTGGTG<br>TCCCATGCTGGGAAGATACTGTTGATCCCAGTGGA |
| 824 | UGT1A4 | 2533119 | AGTCCCAGGGCGGACGCCCACTTGTCCTGGGCCTGCTGCTGTGTGTGCTGGGCCCAGTGGTG<br>TCCCATGCTGGGAAGATACTGTTGATCCCAGTGGA |
| 825 | UGT1A3 | 2533119 | AGTCCCAGGGCGGACGCCCACTTGTCCTGGGCCTGCTGCTGTGTGTGCTGGGCCCAGTGGTG<br>TCCCATGCTGGGAAGATACTGTTGATCCCAGTGGA |
| 826 | UGT1A1 | 2533119 | AGTCCCAGGGCGGACGCCCACTTGTCCTGGGCCTGCTGCTGTGTGTGCTGGGCCCAGTGGTG<br>TCCCATGCTGGGAAGATACTGTTGATCCCAGTGGA |
| 827 | UGT1A8 | 2533120 | TGTCCTAGCACCTGACGCCTCGTTGTACATCAGAGACGGAGCATTTTACACCTTGAAGACGTA<br>CCCTGTGCCATTCCAAAGGGAGGATGTGAAAGAGTCTTTTGTTAGTCTCGGGCATAATGTTTT<br>TGAGAATGATTCTTTCCTGCAGCGTGTGATCAAAACATACAAGAAAATAAAAAAGGACTCTGC<br>TATGCTTTTGTCTGGCTGTTCCCACTTACTGCACAACAAGGAGCTCATGGCCTCCCTGGCAGAA<br>AGCAGCTTTGATGTCATGCTGACGGACCCTTTCCTTCCTTGCAGCCCCATCGTGGCCCAGTACC<br>TGTCTCTGCCCACTGTATTCTTCTTGCATGCACTGCCATGCAGCCTGGAATTTGAGGCTACCCA<br>GTGCCCCAACCCATTCTCCTACGTGCCCAGGCCTCTCTCCTCTCATTCAGATCACATGACCTTCC<br>TGCAGCGGGTGAAGAACATGCTCATTGCCTTTTCACAGAACTTTCTGTGCGACGTGGTTTATT<br>CCCCGTATGCAACCCTTGCCTCAGAATTCCTTCAGAGAGAGGTGACTGTCCA |
| 828 | UGT1A10 | 2533120 | TGTCCTAGCACCTGACGCCTCGTTGTACATCAGAGACGGAGCATTTTACACCTTGAAGACGTA<br>CCCTGTGCCATTCCAAAGGGAGGATGTGAAAGAGTCTTTTGTTAGTCTCGGGCATAATGTTTT<br>TGAGAATGATTCTTTCCTGCAGCGTGTGATCAAAACATACAAGAAAATAAAAAAGGACTCTGC<br>TATGCTTTTGTCTGGCTGTTCCCACTTACTGCACAACAAGGAGCTCATGGCCTCCCTGGCAGAA<br>AGCAGCTTTGATGTCATGCTGACGGACCCTTTCCTTCCTTGCAGCCCCATCGTGGCCCAGTACC<br>TGTCTCTGCCCACTGTATTCTTCTTGCATGCACTGCCATGCAGCCTGGAATTTGAGGCTACCCA<br>GTGCCCCAACCCATTCTCCTACGTGCCCAGGCCTCTCTCCTCTCATTCAGATCACATGACCTTCC<br>TGCAGCGGGTGAAGAACATGCTCATTGCCTTTTCACAGAACTTTCTGTGCGACGTGGTTTATT<br>CCCCGTATGCAACCCTTGCCTCAGAATTCCTTCAGAGAGAGGTGACTGTCCA |
| 829 | UGT1A9 | 2533120 | TGTCCTAGCACCTGACGCCTCGTTGTACATCAGAGACGGAGCATTTTACACCTTGAAGACGTA<br>CCCTGTGCCATTCCAAAGGGAGGATGTGAAAGAGTCTTTTGTTAGTCTCGGGCATAATGTTTT<br>TGAGAATGATTCTTTCCTGCAGCGTGTGATCAAAACATACAAGAAAATAAAAAAGGACTCTGC<br>TATGCTTTTGTCTGGCTGTTCCCACTTACTGCACAACAAGGAGCTCATGGCCTCCCTGGCAGAA<br>AGCAGCTTTGATGTCATGCTGACGGACCCTTTCCTTCCTTGCAGCCCCATCGTGGCCCAGTACC<br>TGTCTCTGCCCACTGTATTCTTCTTGCATGCACTGCCATGCAGCCTGGAATTTGAGGCTACCCA<br>GTGCCCCAACCCATTCTCCTACGTGCCCAGGCCTCTCTCCTCTCATTCAGATCACATGACCTTCC<br>TGCAGCGGGTGAAGAACATGCTCATTGCCTTTTCACAGAACTTTCTGTGCGACGTGGTTTATT<br>CCCCGTATGCAACCCTTGCCTCAGAATTCCTTCAGAGAGAGGTGACTGTCCA |
| 830 | UGT1A5 | 2533120 | TGTCCTAGCACCTGACGCCTCGTTGTACATCAGAGACGGAGCATTTTACACCTTGAAGACGTA<br>CCCTGTGCCATTCCAAAGGGAGGATGTGAAAGAGTCTTTTGTTAGTCTCGGGCATAATGTTTT<br>TGAGAATGATTCTTTCCTGCAGCGTGTGATCAAAACATACAAGAAAATAAAAAAGGACTCTGC<br>TATGCTTTTGTCTGGCTGTTCCCACTTACTGCACAACAAGGAGCTCATGGCCTCCCTGGCAGAA<br>AGCAGCTTTGATGTCATGCTGACGGACCCTTTCCTTCCTTGCAGCCCCATCGTGGCCCAGTACC<br>TGTCTCTGCCCACTGTATTCTTCTTGCATGCACTGCCATGCAGCCTGGAATTTGAGGCTACCCA<br>GTGCCCCAACCCATTCTCCTACGTGCCCAGGCCTCTCTCCTCTCATTCAGATCACATGACCTTCC<br>TGCAGCGGGTGAAGAACATGCTCATTGCCTTTTCACAGAACTTTCTGTGCGACGTGGTTTATT<br>CCCCGTATGCAACCCTTGCCTCAGAATTCCTTCAGAGAGAGGTGACTGTCCA |
| 831 | UGT1A4 | 2533120 | TGTCCTAGCACCTGACGCCTCGTTGTACATCAGAGACGGAGCATTTTACACCTTGAAGACGTA<br>CCCTGTGCCATTCCAAAGGGAGGATGTGAAAGAGTCTTTTGTTAGTCTCGGGCATAATGTTTT<br>TGAGAATGATTCTTTCCTGCAGCGTGTGATCAAAACATACAAGAAAATAAAAAAGGACTCTGC<br>TATGCTTTTGTCTGGCTGTTCCCACTTACTGCACAACAAGGAGCTCATGGCCTCCCTGGCAGAA<br>AGCAGCTTTGATGTCATGCTGACGGACCCTTTCCTTCCTTGCAGCCCCATCGTGGCCCAGTACC<br>TGTCTCTGCCCACTGTATTCTTCTTGCATGCACTGCCATGCAGCCTGGAATTTGAGGCTACCCA |

TABLE 13-continued

Subtyping Target Sequences

| SEQ ID NO. | Gene | Affy Probeset ID | Sequence |
|---|---|---|---|
| | | | GTGCCCCAACCCATTCTCCTACGTGCCCAGGCCTCTCTCCTCTCATTCAGATCACATGACCTTCC<br>TGCAGCGGGTGAAGAACATGCTCATTGCCTTTTCACAGAACTTTCTGTGCGACGTGGTTTATT<br>CCCCGTATGCAACCCTTGCCTCAGAATTCCTTCAGAGAGAGGTGACTGTCCA |
| 832 | UGT1A3 | 2533120 | TGTCCTAGCACCTGACGCCTCGTTGTACATCAGAGACGGAGCATTTTACACCTTGAAGACGTA<br>CCCTGTGCCATTCCAAAGGGAGGATGTGAAAGAGTCTTTTGTTAGTCTCGGGCATAATGTTTT<br>TGAGAATGATTCTTTCCTGCAGCGTGTGATCAAAACATACAAGAAAATAAAAAAGGACTCTGC<br>TATGCTTTTGTCTGGCTGTTCCCACTTACTGCACAACAAGGAGCTCATGGCCTCCCTGGCAGAA<br>AGCAGCTTTGATGTCATGCTGACGGACCCTTTCCTTCCTTGCAGCCCCATCGTGGCCCAGTACC<br>TGTCTCTGCCCACTGTATTCTTCTTGCATGCACTGCCATGCAGCCTGGAATTTGAGGCTACCCA<br>GTGCCCCAACCCATTCTCCTACGTGCCCAGGCCTCTCTCCTCTCATTCAGATCACATGACCTTCC<br>TGCAGCGGGTGAAGAACATGCTCATTGCCTTTTCACAGAACTTTCTGTGCGACGTGGTTTATT<br>CCCCGTATGCAACCCTTGCCTCAGAATTCCTTCAGAGAGAGGTGACTGTCCA |
| 833 | UGT1A1 | 2533120 | TGTCCTAGCACCTGACGCCTCGTTGTACATCAGAGACGGAGCATTTTACACCTTGAAGACGTA<br>CCCTGTGCCATTCCAAAGGGAGGATGTGAAAGAGTCTTTTGTTAGTCTCGGGCATAATGTTTT<br>TGAGAATGATTCTTTCCTGCAGCGTGTGATCAAAACATACAAGAAAATAAAAAAGGACTCTGC<br>TATGCTTTTGTCTGGCTGTTCCCACTTACTGCACAACAAGGAGCTCATGGCCTCCCTGGCAGAA<br>AGCAGCTTTGATGTCATGCTGACGGACCCTTTCCTTCCTTGCAGCCCCATCGTGGCCCAGTACC<br>TGTCTCTGCCCACTGTATTCTTCTTGCATGCACTGCCATGCAGCCTGGAATTTGAGGCTACCCA<br>GTGCCCCAACCCATTCTCCTACGTGCCCAGGCCTCTCTCCTCTCATTCAGATCACATGACCTTCC<br>TGCAGCGGGTGAAGAACATGCTCATTGCCTTTTCACAGAACTTTCTGTGCGACGTGGTTTATT<br>CCCCGTATGCAACCCTTGCCTCAGAATTCCTTCAGAGAGAGGTGACTGTCCA |
| 834 | UGT1A8 | 2533123 | TTGAAGCCTACATTAATGCTTCTGGAGAACATGGAATTGTGGTTTTCTCTTTGGGATCAATGGT<br>CTCAGAAATTCCAGAGAAGAAAGCTATGGCAATTGCTGATGCTTTGGGCAAAATCCC |
| 835 | UGT1A10 | 2533123 | TTGAAGCCTACATTAATGCTTCTGGAGAACATGGAATTGTGGTTTTCTCTTTGGGATCAATGGT<br>CTCAGAAATTCCAGAGAAGAAAGCTATGGCAATTGCTGATGCTTTGGGCAAAATCCC |
| 836 | UGT1A9 | 2533123 | TTGAAGCCTACATTAATGCTTCTGGAGAACATGGAATTGTGGTTTTCTCTTTGGGATCAATGGT<br>CTCAGAAATTCCAGAGAAGAAAGCTATGGCAATTGCTGATGCTTTGGGCAAAATCCC |
| 837 | UGT1A5 | 2533123 | TTGAAGCCTACATTAATGCTTCTGGAGAACATGGAATTGTGGTTTTCTCTTTGGGATCAATGGT<br>CTCAGAAATTCCAGAGAAGAAAGCTATGGCAATTGCTGATGCTTTGGGCAAAATCCC |
| 838 | UGT1A4 | 2533123 | TTGAAGCCTACATTAATGCTTCTGGAGAACATGGAATTGTGGTTTTCTCTTTGGGATCAATGGT<br>CTCAGAAATTCCAGAGAAGAAAGCTATGGCAATTGCTGATGCTTTGGGCAAAATCCC |
| 839 | UGT1A3 | 2533123 | TTGAAGCCTACATTAATGCTTCTGGAGAACATGGAATTGTGGTTTTCTCTTTGGGATCAATGGT<br>CTCAGAAATTCCAGAGAAGAAAGCTATGGCAATTGCTGATGCTTTGGGCAAAATCCC |
| 840 | UGT1A1 | 2533123 | TTGAAGCCTACATTAATGCTTCTGGAGAACATGGAATTGTGGTTTTCTCTTTGGGATCAATGGT<br>CTCAGAAATTCCAGAGAAGAAAGCTATGGCAATTGCTGATGCTTTGGGCAAAATCCC |
| 841 | UGT1A8 | 2533124 | GTCCTGTGGCGGTACACTGGAACCCGACCATCGAATCTTGCGAACAACACGATACTTGTTAAG<br>TGGCTACCCCAAAACGATCTGCTT |
| 842 | UGT1A10 | 2533124 | GTCCTGTGGCGGTACACTGGAACCCGACCATCGAATCTTGCGAACAACACGATACTTGTTAAG<br>TGGCTACCCCAAAACGATCTGCTT |
| 843 | UGT1A9 | 2533124 | GTCCTGTGGCGGTACACTGGAACCCGACCATCGAATCTTGCGAACAACACGATACTTGTTAAG<br>TGGCTACCCCAAAACGATCTGCTT |
| 844 | UGT1A5 | 2533124 | GTCCTGTGGCGGTACACTGGAACCCGACCATCGAATCTTGCGAACAACACGATACTTGTTAAG<br>TGGCTACCCCAAAACGATCTGCTT |
| 845 | UGT1A4 | 2533124 | GTCCTGTGGCGGTACACTGGAACCCGACCATCGAATCTTGCGAACAACACGATACTTGTTAAG<br>TGGCTACCCCAAAACGATCTGCTT |
| 846 | UGT1A3 | 2533124 | GTCCTGTGGCGGTACACTGGAACCCGACCATCGAATCTTGCGAACAACACGATACTTGTTAAG<br>TGGCTACCCCAAAACGATCTGCTT |
| 847 | UGT1A1 | 2533124 | GTCCTGTGGCGGTACACTGGAACCCGACCATCGAATCTTGCGAACAACACGATACTTGTTAAG<br>TGGCTACCCCAAAACGATCTGCTT |
| 848 | UGT1A8 | 2533125 | GTCACCCGATGACCCGTGCCTTTATCACCCATGCTGGTTCCCATGGTGTTTATGAAAGCATATG<br>CAATGGCGTTCCCATGGTGATGATGCCCTTGTTTGGTGATCAGATGGACAATGCAAAGCGCAT<br>GGAGACTAAGGGAGCTGGAGTGACCCTGAATGTTCTGGA |
| 849 | UGT1A10 | 2533125 | GTCACCCGATGACCCGTGCCTTTATCACCCATGCTGGTTCCCATGGTGTTTATGAAAGCATATG<br>CAATGGCGTTCCCATGGTGATGATGCCCTTGTTTGGTGATCAGATGGACAATGCAAAGCGCAT<br>GGAGACTAAGGGAGCTGGAGTGACCCTGAATGTTCTGGA |

TABLE 13-continued

Subtyping Target Sequences

| SEQ ID NO. | Gene | Affy Probeset ID | Sequence |
|---|---|---|---|
| 850 | UGT1A9 | 2533125 | GTCACCCGATGACCCGTGCCTTTATCACCCATGCTGGTTCCCATGGTGTTTATGAAAGCATATG<br>CAATGGCGTTCCCATGGTGATGATGCCCTTGTTTGGTGATCAGATGGACAATGCAAAGCGCAT<br>GGAGACTAAGGGAGCTGGAGTGACCCTGAATGTTCTGGA |
| 851 | UGT1A5 | 2533125 | GTCACCCGATGACCCGTGCCTTTATCACCCATGCTGGTTCCCATGGTGTTTATGAAAGCATATG<br>CAATGGCGTTCCCATGGTGATGATGCCCTTGTTTGGTGATCAGATGGACAATGCAAAGCGCAT<br>GGAGACTAAGGGAGCTGGAGTGACCCTGAATGTTCTGGA |
| 852 | UGT1A4 | 2533125 | GTCACCCGATGACCCGTGCCTTTATCACCCATGCTGGTTCCCATGGTGTTTATGAAAGCATATG<br>CAATGGCGTTCCCATGGTGATGATGCCCTTGTTTGGTGATCAGATGGACAATGCAAAGCGCAT<br>GGAGACTAAGGGAGCTGGAGTGACCCTGAATGTTCTGGA |
| 853 | UGT1A3 | 2533125 | GTCACCCGATGACCCGTGCCTTTATCACCCATGCTGGTTCCCATGGTGTTTATGAAAGCATATG<br>CAATGGCGTTCCCATGGTGATGATGCCCTTGTTTGGTGATCAGATGGACAATGCAAAGCGCAT<br>GGAGACTAAGGGAGCTGGAGTGACCCTGAATGTTCTGGA |
| 854 | UGT1A1 | 2533125 | GTCACCCGATGACCCGTGCCTTTATCACCCATGCTGGTTCCCATGGTGTTTATGAAAGCATATG<br>CAATGGCGTTCCCATGGTGATGATGCCCTTGTTTGGTGATCAGATGGACAATGCAAAGCGCAT<br>GGAGACTAAGGGAGCTGGAGTGACCCTGAATGTTCTGGA |
| 855 | UGT1A8 | 2533126 | AAGAAGCAGCAGTCAGGAAGACAGATGTGA |
| 856 | UGT1A10 | 2533126 | AAGAAGCAGCAGTCAGGAAGACAGATGTGA |
| 857 | UGT1A9 | 2533126 | AAGAAGCAGCAGTCAGGAAGACAGATGTGA |
| 858 | UGT1A5 | 2533126 | AAGAAGCAGCAGTCAGGAAGACAGATGTGA |
| 859 | UGT1A4 | 2533126 | AAGAAGCAGCAGTCAGGAAGACAGATGTGA |
| 860 | UGT1A3 | 2533126 | AAGAAGCAGCAGTCAGGAAGACAGATGTGA |
| 861 | UGT1A1 | 2533126 | AAGAAGCAGCAGTCAGGAAGACAGATGTGA |
| 862 | UGT1A8 | 2533127 | TTCAGATGAGAGGAGACGGAACACGGGGACACACCAGCTTGAGCAAGGGACAACAGGGGA<br>GGACTGATGACTGACTTCCCACCTTTGAGGTGCTAATGTGTGTGTGGTGGCACTGGATAAAA<br>GATCAATGTTGGCTAGGCACCATGGCACACGCCTGTAGTCCCAGCCACTCTGGAGGCTAAGG<br>CGGGAGGATTGCTTGAGCCCAGAAGTTGGAGGCTGCTATGAGCCGTGATCATGCCACTGCAC<br>TCCAGCAACCTGGGCAACAGAGTGAGACCCTGTCTCAAAAAAAAAAAAAAAATGAAAAGTC<br>CACATAACCTGAGCATCATGTGCCCAGAGCGTTGGGTGGTGTGGTCCCATTCCTTCCTTCCAG<br>CGGCTTCTTCTGGCCACCTCAATGTCAGGATGTC |
| 863 | UGT1A10 | 2533127 | TTCAGATGAGAGGAGACGGAACACGGGGACACACCAGCTTGAGCAAGGGACAACAGGGGA<br>GGACTGATGACTGACTTCCCACCTTTGAGGTGCTAATGTGTGTGTGGTGGCACTGGATAAAA<br>GATCAATGTTGGCTAGGCACCATGGCACACGCCTGTAGTCCCAGCCACTCTGGAGGCTAAGG<br>CGGGAGGATTGCTTGAGCCCAGAAGTTGGAGGCTGCTATGAGCCGTGATCATGCCACTGCAC<br>TCCAGCAACCTGGGCAACAGAGTGAGACCCTGTCTCAAAAAAAAAAAAAAAATGAAAAGTC<br>CACATAACCTGAGCATCATGTGCCCAGAGCGTTGGGTGGTGTGGTCCCATTCCTTCCTTCCAG<br>CGGCTTCTTCTGGCCACCTCAATGTCAGGATGTC |
| 864 | UGT1A9 | 2533127 | TTCAGATGAGAGGAGACGGAACACGGGGACACACCAGCTTGAGCAAGGGACAACAGGGGA<br>GGACTGATGACTGACTTCCCACCTTTGAGGTGCTAATGTGTGTGTGGTGGCACTGGATAAAA<br>GATCAATGTTGGCTAGGCACCATGGCACACGCCTGTAGTCCCAGCCACTCTGGAGGCTAAGG<br>CGGGAGGATTGCTTGAGCCCAGAAGTTGGAGGCTGCTATGAGCCGTGATCATGCCACTGCAC<br>TCCAGCAACCTGGGCAACAGAGTGAGACCCTGTCTCAAAAAAAAAAAAAAAATGAAAAGTC<br>CACATAACCTGAGCATCATGTGCCCAGAGCGTTGGGTGGTGTGGTCCCATTCCTTCCTTCCAG<br>CGGCTTCTTCTGGCCACCTCAATGTCAGGATGTC |
| 865 | UGT1A5 | 2533127 | TTCAGATGAGAGGAGACGGAACACGGGGACACACCAGCTTGAGCAAGGGACAACAGGGGA<br>GGACTGATGACTGACTTCCCACCTTTGAGGTGCTAATGTGTGTGTGGTGGCACTGGATAAAA<br>GATCAATGTTGGCTAGGCACCATGGCACACGCCTGTAGTCCCAGCCACTCTGGAGGCTAAGG<br>CGGGAGGATTGCTTGAGCCCAGAAGTTGGAGGCTGCTATGAGCCGTGATCATGCCACTGCAC<br>TCCAGCAACCTGGGCAACAGAGTGAGACCCTGTCTCAAAAAAAAAAAAAAAATGAAAAGTC<br>CACATAACCTGAGCATCATGTGCCCAGAGCGTTGGGTGGTGTGGTCCCATTCCTTCCTTCCAG<br>CGGCTTCTTCTGGCCACCTCAATGTCAGGATGTC |
| 866 | UGT1A4 | 2533127 | TTCAGATGAGAGGAGACGGAACACGGGGACACACCAGCTTGAGCAAGGGACAACAGGGGA<br>GGACTGATGACTGACTTCCCACCTTTGAGGTGCTAATGTGTGTGTGGTGGCACTGGATAAAA<br>GATCAATGTTGGCTAGGCACCATGGCACACGCCTGTAGTCCCAGCCACTCTGGAGGCTAAGG<br>CGGGAGGATTGCTTGAGCCCAGAAGTTGGAGGCTGCTATGAGCCGTGATCATGCCACTGCAC<br>TCCAGCAACCTGGGCAACAGAGTGAGACCCTGTCTCAAAAAAAAAAAAAAAATGAAAAGTC<br>CACATAACCTGAGCATCATGTGCCCAGAGCGTTGGGTGGTGTGGTCCCATTCCTTCCTTCCAG<br>CGGCTTCTTCTGGCCACCTCAATGTCAGGATGTC |

TABLE 13-continued

Subtyping Target Sequences

| SEQ ID NO. | Gene | Affy Probeset ID | Sequence |
|---|---|---|---|
| 867 | UGT1A3 | 2533127 | TTCAGATGAGAGGAGACGGAACACGGGGACACACCAGCTTGAGCAAGGGACAACAGGGGA<br>GGACTGATGACTGACTTCCCACCTTTGAGGTGCTAATGTGTGTGGTGGCACTGGATAAAA<br>GATCAATGTTGGCTAGGCACCATGGCACACGCCTGTAGTCCCAGCCACTCTGGAGGCTAAGG<br>CGGGAGGATTGCTTGAGCCCAGAAGTTGGAGGCTGCTATGAGCCGTGATCATGCCACTGCAC<br>TCCAGCAACCTGGGCAACAGAGTGAGACCCTGTCTCAAAAAAAAAAAAAAAAATGAAAAGTC<br>CACATAACCTGAGCATCATGTGCCCAGAGCGTTGGGTGGTGTGGTCCCATTCCTTCCTTCCAG<br>CGGCTTCTTCTGGCCACCTCAATGTCAGGATGTC |
| 868 | UGT1A1 | 2533127 | TTCAGATGAGAGGAGACGGAACACGGGGACACACCAGCTTGAGCAAGGGACAACAGGGGA<br>GGACTGATGACTGACTTCCCACCTTTGAGGTGCTAATGTGTGTGGTGGCACTGGATAAAA<br>GATCAATGTTGGCTAGGCACCATGGCACACGCCTGTAGTCCCAGCCACTCTGGAGGCTAAGG<br>CGGGAGGATTGCTTGAGCCCAGAAGTTGGAGGCTGCTATGAGCCGTGATCATGCCACTGCAC<br>TCCAGCAACCTGGGCAACAGAGTGAGACCCTGTCTCAAAAAAAAAAAAAAAAATGAAAAGTC<br>CACATAACCTGAGCATCATGTGCCCAGAGCGTTGGGTGGTGTGGTCCCATTCCTTCCTTCCAG<br>CGGCTTCTTCTGGCCACCTCAATGTCAGGATGTC |
| 869 | UGT1A8 | 2533128 | GAAGCTCCTTCTTGAGGCTCACATTATGGATATAATTTTGATTCTTTCTTCAGTGGTATAGATA<br>ACTACTTGTAACCTAAGAACAACTTGGTGAAAGTCCTCTAATACATTATTTTTAAAAAAACAC<br>AAATCAATGAGCTCAACTTATTAACTAACTTTCATCTATTCATTTTTGAGCCATCCCTGTCTGAT<br>TGTGAATCTCCATGATTCCAACACTCTGAGCTG |
| 870 | UGT1A10 | 2533128 | GAAGCTCCTTCTTGAGGCTCACATTATGGATATAATTTTGATTCTTTCTTCAGTGGTATAGATA<br>ACTACTTGTAACCTAAGAACAACTTGGTGAAAGTCCTCTAATACATTATTTTTAAAAAAACAC<br>AAATCAATGAGCTCAACTTATTAACTAACTTTCATCTATTCATTTTTGAGCCATCCCTGTCTGAT<br>TGTGAATCTCCATGATTCCAACACTCTGAGCTG |
| 871 | UGT1A9 | 2533128 | GAAGCTCCTTCTTGAGGCTCACATTATGGATATAATTTTGATTCTTTCTTCAGTGGTATAGATA<br>ACTACTTGTAACCTAAGAACAACTTGGTGAAAGTCCTCTAATACATTATTTTTAAAAAAACAC<br>AAATCAATGAGCTCAACTTATTAACTAACTTTCATCTATTCATTTTTGAGCCATCCCTGTCTGAT<br>TGTGAATCTCCATGATTCCAACACTCTGAGCTG |
| 872 | UGT1A5 | 2533128 | GAAGCTCCTTCTTGAGGCTCACATTATGGATATAATTTTGATTCTTTCTTCAGTGGTATAGATA<br>ACTACTTGTAACCTAAGAACAACTTGGTGAAAGTCCTCTAATACATTATTTTTAAAAAAACAC<br>AAATCAATGAGCTCAACTTATTAACTAACTTTCATCTATTCATTTTTGAGCCATCCCTGTCTGAT<br>TGTGAATCTCCATGATTCCAACACTCTGAGCTG |
| 873 | UGT1A4 | 2533128 | GAAGCTCCTTCTTGAGGCTCACATTATGGATATAATTTTGATTCTTTCTTCAGTGGTATAGATA<br>ACTACTTGTAACCTAAGAACAACTTGGTGAAAGTCCTCTAATACATTATTTTTAAAAAAACAC<br>AAATCAATGAGCTCAACTTATTAACTAACTTTCATCTATTCATTTTTGAGCCATCCCTGTCTGAT<br>TGTGAATCTCCATGATTCCAACACTCTGAGCTG |
| 874 | UGT1A3 | 2533128 | GAAGCTCCTTCTTGAGGCTCACATTATGGATATAATTTTGATTCTTTCTTCAGTGGTATAGATA<br>ACTACTTGTAACCTAAGAACAACTTGGTGAAAGTCCTCTAATACATTATTTTTAAAAAAACAC<br>AAATCAATGAGCTCAACTTATTAACTAACTTTCATCTATTCATTTTTGAGCCATCCCTGTCTGAT<br>TGTGAATCTCCATGATTCCAACACTCTGAGCTG |
| 875 | UGT1A1 | 2533128 | GAAGCTCCTTCTTGAGGCTCACATTATGGATATAATTTTGATTCTTTCTTCAGTGGTATAGATA<br>ACTACTTGTAACCTAAGAACAACTTGGTGAAAGTCCTCTAATACATTATTTTTAAAAAAACAC<br>AAATCAATGAGCTCAACTTATTAACTAACTTTCATCTATTCATTTTTGAGCCATCCCTGTCTGAT<br>TGTGAATCTCCATGATTCCAACACTCTGAGCTG |
| 876 | UGT1A8 | 2533130 | GTACCAGTACCATTCCTTGGACGTGATTGGTTTCCTCTTGGCCGTCGTGCTGACAGTGGCCTTC<br>ATCACCTTTAAATGTTGTGCTTATGGCTACCGGAAATGCTTGGGGAAAAAAGGGCGAGTTAA<br>GAAAGCCCACAAATC |
| 877 | UGT1A10 | 2533130 | GTACCAGTACCATTCCTTGGACGTGATTGGTTTCCTCTTGGCCGTCGTGCTGACAGTGGCCTTC<br>ATCACCTTTAAATGTTGTGCTTATGGCTACCGGAAATGCTTGGGGAAAAAAGGGCGAGTTAA<br>GAAAGCCCACAAATC |
| 878 | UGT1A9 | 2533130 | GTACCAGTACCATTCCTTGGACGTGATTGGTTTCCTCTTGGCCGTCGTGCTGACAGTGGCCTTC<br>ATCACCTTTAAATGTTGTGCTTATGGCTACCGGAAATGCTTGGGGAAAAAAGGGCGAGTTAA<br>GAAAGCCCACAAATC |
| 879 | UGT1A5 | 2533130 | GTACCAGTACCATTCCTTGGACGTGATTGGTTTCCTCTTGGCCGTCGTGCTGACAGTGGCCTTC<br>ATCACCTTTAAATGTTGTGCTTATGGCTACCGGAAATGCTTGGGGAAAAAAGGGCGAGTTAA<br>GAAAGCCCACAAATC |
| 880 | UGT1A4 | 2533130 | GTACCAGTACCATTCCTTGGACGTGATTGGTTTCCTCTTGGCCGTCGTGCTGACAGTGGCCTTC<br>ATCACCTTTAAATGTTGTGCTTATGGCTACCGGAAATGCTTGGGGAAAAAAGGGCGAGTTAA<br>GAAAGCCCACAAATC |
| 881 | UGT1A3 | 2533130 | GTACCAGTACCATTCCTTGGACGTGATTGGTTTCCTCTTGGCCGTCGTGCTGACAGTGGCCTTC<br>ATCACCTTTAAATGTTGTGCTTATGGCTACCGGAAATGCTTGGGGAAAAAAGGGCGAGTTAA<br>GAAAGCCCACAAATC |

TABLE 13-continued

Subtyping Target Sequences

| SEQ ID NO. | Gene | Affy Probeset ID | Sequence |
|---|---|---|---|
| 882 | UGT1A1 | 2533130 | GTACCAGTACCATTCCTTGGACGTGATTGGTTTCCTCTTGGCCGTCGTGCTGACAGTGGCCTTC ATCACCTTTAAATGTTGTGCTTATGGCTACCGGAAATGCTTGGGGAAAAAAGGGCGAGTTAA GAAAGCCCACAAATC |
| 883 | UGT1A8 | 2533131 | AAATTTTGAACCATTCCCTAGTCATTTCCAAACTTGAAAACAGAATCAGTGTTAAATTCATTTT ATTCTTATTAAGGAAATACTTTGCATAAATTAATCAGCCCC |
| 884 | UGT1A10 | 2533131 | AAATTTTGAACCATTCCCTAGTCATTTCCAAACTTGAAAACAGAATCAGTGTTAAATTCATTTT ATTCTTATTAAGGAAATACTTTGCATAAATTAATCAGCCCC |
| 885 | UGT1A9 | 2533131 | AAATTTTGAACCATTCCCTAGTCATTTCCAAACTTGAAAACAGAATCAGTGTTAAATTCATTTT ATTCTTATTAAGGAAATACTTTGCATAAATTAATCAGCCCC |
| 886 | UGT1A5 | 2533131 | AAATTTTGAACCATTCCCTAGTCATTTCCAAACTTGAAAACAGAATCAGTGTTAAATTCATTTT ATTCTTATTAAGGAAATACTTTGCATAAATTAATCAGCCCC |
| 887 | UGT1A4 | 2533131 | AAATTTTGAACCATTCCCTAGTCATTTCCAAACTTGAAAACAGAATCAGTGTTAAATTCATTTT ATTCTTATTAAGGAAATACTTTGCATAAATTAATCAGCCCC |
| 888 | UGT1A3 | 2533131 | AAATTTTGAACCATTCCCTAGTCATTTCCAAACTTGAAAACAGAATCAGTGTTAAATTCATTTT ATTCTTATTAAGGAAATACTTTGCATAAATTAATCAGCCCC |
| 889 | UGT1A1 | 2533131 | AAATTTTGAACCATTCCCTAGTCATTTCCAAACTTGAAAACAGAATCAGTGTTAAATTCATTTT ATTCTTATTAAGGAAATACTTTGCATAAATTAATCAGCCCC |
| 890 | UGT1A8 | 2533132 | CAGACAGGCTGGCATTCTAGATTACTTTTCTTACTCTGAAACATGGCCTGTTTGGGAGTGCGG GATTCAAAGGTGGTCCCACGGCTGCCCCTACTGCAAATGGCAGTTTTAATCTTATCTTTTGGCT TCTGCAGATGGTTGCAATTGATCCTTAACCAATAATGGTCAGTCCTCATCTCTGTCGTGCTTCA TAGGTGCCACCTTGTGTGTTTAAAGAAGGGAAGCTTTGTACCTTTAGAGTGTA |
| 891 | UGT1A10 | 2533132 | CAGACAGGCTGGCATTCTAGATTACTTTTCTTACTCTGAAACATGGCCTGTTTGGGAGTGCGG GATTCAAAGGTGGTCCCACGGCTGCCCCTACTGCAAATGGCAGTTTTAATCTTATCTTTTGGCT TCTGCAGATGGTTGCAATTGATCCTTAACCAATAATGGTCAGTCCTCATCTCTGTCGTGCTTCA TAGGTGCCACCTTGTGTGTTTAAAGAAGGGAAGCTTTGTACCTTTAGAGTGTA |
| 892 | UGT1A9 | 2533132 | CAGACAGGCTGGCATTCTAGATTACTTTTCTTACTCTGAAACATGGCCTGTTTGGGAGTGCGG GATTCAAAGGTGGTCCCACGGCTGCCCCTACTGCAAATGGCAGTTTTAATCTTATCTTTTGGCT TCTGCAGATGGTTGCAATTGATCCTTAACCAATAATGGTCAGTCCTCATCTCTGTCGTGCTTCA TAGGTGCCACCTTGTGTGTTTAAAGAAGGGAAGCTTTGTACCTTTAGAGTGTA |
| 893 | UGT1A5 | 2533132 | CAGACAGGCTGGCATTCTAGATTACTTTTCTTACTCTGAAACATGGCCTGTTTGGGAGTGCGG GATTCAAAGGTGGTCCCACGGCTGCCCCTACTGCAAATGGCAGTTTTAATCTTATCTTTTGGCT TCTGCAGATGGTTGCAATTGATCCTTAACCAATAATGGTCAGTCCTCATCTCTGTCGTGCTTCA TAGGTGCCACCTTGTGTGTTTAAAGAAGGGAAGCTTTGTACCTTTAGAGTGTA |
| 894 | UGT1A4 | 2533132 | CAGACAGGCTGGCATTCTAGATTACTTTTCTTACTCTGAAACATGGCCTGTTTGGGAGTGCGG GATTCAAAGGTGGTCCCACGGCTGCCCCTACTGCAAATGGCAGTTTTAATCTTATCTTTTGGCT TCTGCAGATGGTTGCAATTGATCCTTAACCAATAATGGTCAGTCCTCATCTCTGTCGTGCTTCA TAGGTGCCACCTTGTGTGTTTAAAGAAGGGAAGCTTTGTACCTTTAGAGTGTA |
| 895 | UGT1A3 | 2533132 | CAGACAGGCTGGCATTCTAGATTACTTTTCTTACTCTGAAACATGGCCTGTTTGGGAGTGCGG GATTCAAAGGTGGTCCCACGGCTGCCCCTACTGCAAATGGCAGTTTTAATCTTATCTTTTGGCT TCTGCAGATGGTTGCAATTGATCCTTAACCAATAATGGTCAGTCCTCATCTCTGTCGTGCTTCA TAGGTGCCACCTTGTGTGTTTAAAGAAGGGAAGCTTTGTACCTTTAGAGTGTA |
| 896 | UGT1A1 | 2533132 | CAGACAGGCTGGCATTCTAGATTACTTTTCTTACTCTGAAACATGGCCTGTTTGGGAGTGCGG GATTCAAAGGTGGTCCCACGGCTGCCCCTACTGCAAATGGCAGTTTTAATCTTATCTTTTGGCT TCTGCAGATGGTTGCAATTGATCCTTAACCAATAATGGTCAGTCCTCATCTCTGTCGTGCTTCA TAGGTGCCACCTTGTGTGTTTAAAGAAGGGAAGCTTTGTACCTTTAGAGTGTA |
| 897 | TWIST2 | 2535028 | AGTCAGCCTGGAATTCTTACTTTCACGCCGCTATTCTTTTCCTTTCTCCGTGATTGCTTGGCTAG CCATTTAAAAAAAATATTCTCTGTTCAGTGTATATGTTGCTTGTTTGTTTTATTTATTGAGATA TTTTTACAAGCTAAGTGACTGCAGTG |
| 898 | EFEMP1 | 2554034 | TCTAAACCACATTGGAACTGACCTGAAGAAGCAAACTCGGAAAATATAATAACATCCCTGAAT TCAGGACTTCCACAAGATGCAGAACAAATGGATAAAAGGTATTTCACTGGAGAAGTTTTAAT TTCTAAGTAAAATTTAAATCCTAACACTTCACTAATTTATAACTAAAATTTCTCATCTTCGTACTT GATGCTCACAGAGGAAGAAAATGATGATGGTTTTTATTCCTGGCATCCAGAGTGACAGTGAA CTTAAGCAAATTACCCTCCTACCCAATTCTATGG |
| 899 | EFEMP1 | 2554035 | TATTTTCATATCCAGCCTAAAGGTGGTTGTTTATTATATAGTAATAAATCATTGCTGTA |

TABLE 13-continued

Subtyping Target Sequences

| SEQ ID NO. | Gene | Affy Probeset ID | Sequence |
|---|---|---|---|
| 900 | EFEMP1 | 2554036 | TCTTTTCTAAGAGTCAACCACAGGCATTTAAGTCAGCCAAAGAATATTGTTACCTTAAAGCACT<br>ATTTTATTTATAGATATATCTAGTGCATCTACATCTCTATACTGTACACTCACCCATAATTCAAA<br>CAATTACACCATGGTATAAAGTGGGCATTTAATATGTAAAGATTCAAAGTTTGTCTTTATTACT<br>ATATGTAAATTAGACATTAATCCACTAAACTGGTCTTCTTCAAGAGAGCTAAGTATACACTATC<br>TGGTGAAACTTGGATTCTTTCCTATAAAAGTGGGACCAAGCAATGATGATCTTCTGTGGTGCT<br>TAAGGAAACTTACTA |
| 901 | EFEMP1 | 2554037 | TGCAATGCTTGTGCTCGTGAAGTCATTATCAGGACCAAGAGAACATATCGTGGACCTGGAGA<br>TGCTGACAGTCAGCAGTATAGGGACCTTCCGCACAAGCTCTGTGTTA |
| 902 | EFEMP1 | 2554040 | ACAAATACATGAGCATCCGATCTGATAGGTCTGTGCCATCAGACATCTTCCAGATACAGGCCA<br>CAACTATTTATGCCAACACCATCAATACTTTTCGGATTAAATCTGGA |
| 903 | EFEMP1 | 2554041 | ACCACAAATGAATGCCGGGAGGATGAAATGTGTTGGAATTATCATGGCGGCTTCCGTTGTTA<br>TCCACGAAATCCTTGTCAAGATC |
| 904 | EFEMP1 | 2554042 | GAACCTCAAGCTACCTGTGTCAATATCAATGTGTCAATGAACCTGGGAAATTCTCATGTATGT<br>GCCCCCAGGGATACCAAGTGGTGAGAAGTAGAACATG |
| 905 | EFEMP1 | 2554045 | GTGCTACAACATTCTTGGTTCATTCATCTGTCAGTGCAATCAAGGATATGAGCTAAGCAGTGA<br>CAGGCTCAACTGTGAAG |
| 906 | EFEMP1 | 2554046 | TGAATGTACCATCCCTCCATATTGCCACCAAAGATGCGTGAATACACCAGGCTCATTTTATTGC<br>CAGTGCAGTCCTGGGTTTCAATTGGCAGCAAACAACTATACCTGCGTA |
| 907 | EFEMP1 | 2554047 | CATAGACGAGTGCACTGCAGGGACGCACAACTGTAGAGCAGACCAAGTGTGCATCAATTTAC<br>GGGGATCCTTTGCATGTCAGTG |
| 908 | EFEMP1 | 2554056 | CTGCTGCAGTCGCAGGCCCTGAAATGCAGACTGGCCGAAATAACTTTGTCATCCGGCGGAAC<br>CCAGCTGACCCTCAGCGCATTCCCTCCAACCCTTCCCACCGTATCCAGTGTGCAGCAGGCTAC<br>GAGCAAA |
| 909 | EFEMP1 | 2554057 | GCAACCACCGGGGTTGTAGCTGCCAGCAGC |
| 910 | EFEMP1 | 2554058 | GTGACATTGTCCCAGACGCTTGTAAAGGTGGAATGAAGTGTGTCAACCACTATGGAGGATAC<br>CTCTGCCTTCCGAAAACAGCCCAGATTATTGTCAATAATGAACAGCCTCAGCA |
| 911 | EFEMP1 | 2554059 | AATGCACTGACGGATATGAGTGGGATCCTGTGAGACAGC |
| 912 | EFEMP1 | 2554062 | CGGTTCAGCGGGATTCTGTGACAAAAAAAGACTTTACACACCCCTGCCAGTGTATTTGGGCTA<br>TACTCTGCTGAGGGTGATAAATTAAACAACACTTCATTCATGCTTCATATCTAAGATTCGTTGT<br>AAAATTGCCCCCTTGATCCTTTCAAAAGTTCATTGGGCTCACCACCTAAGATAGGAACCAACAT<br>GTAATCATTTGTGCAGGGCTAAAAATGGGATCCGTTCA |
| 913 | EFEMP1 | 2554063 | ACACCGAAGAAACCATCACGTACACG |
| 914 | EFEMP1 | 2554064 | TGCAGCCTGCTTTGTAGGTGCAGTATAAAATGCACGCTGAATGTCTTTTGTATGTAAACAGCG<br>TAGCAGGATGGAGTAACGTGAAATGCAATTCTACAGCAGTTTTTACGTCTTTGCTGCCTCGTT<br>CGTTGGCTACCGAGAAGGTTCAGGAGGGGAGGGGAGATGAGAAAGCAGATTGGAAGTTG<br>AGTATGGTGGAGCCTCAGCCTCTCCCACCCTCCTTTCCTCGCTTGTGCTCACTGCTAAAG |
| 915 | EFEMP1 | 2554067 | CGCTGCCGGACTTCGCCAGATCAGACCCACGGGGCTGCCCTC |
| 916 | MALL | 2570194 | TTGAGGCCTTACAGTTTTGTATCTACATTTTTCCCTCCTGGGGTTTGCGGGGACAGGGACAG<br>AACTACAGGAGTCATGGGAAAGAAAATTCTGGCTTCACTACTGCTCACTGCTCACTTTCTGAT<br>CACTCTGATACTTTTTTTTTTTTTTTTTTTTGCAACCTGATACCTTGAAAAGCTTCTATGTGTC<br>TCTCCTTTTGTTGCCTGGCAGCTGTCTAGGATGATCACTGATTACTATTTACTAAGTAGCCACA<br>TGC |
| 917 | MALL | 2570195 | GACTGAGCGATGACACCACACTTTGTTTGGACATTTAAATTCACTCTGCTGAATAGGAGGAAG<br>CTTTTCTTTTTCCTGGGAAAACAACTGTCTCTTGGAATTATCTGACCATGAACTTGCTCTTCTAG<br>ACAACTCACATCAAAGCCCTCACTCCACTAATGGAGAATCCTAGCCCCACTAATGCCAAGTCT<br>GTTTGGGATTTTGCCTCAGCTATGGGCTTCCTAGAGTAGGTCTAGGGGAATACTCAGTCTG<br>ATCTTTTTTTGTTTGTTTTATTTTGTTTTTTTGAGACGGAGTCTCGCTCTTCCTCCAAGGCTGG<br>AGTGCAGTGACGCGATCTCCACTCACTGCAGGCTCCGCCTCCCGGGTTCCCGCCATTCTCCTG<br>CCTCAGCCTCCCGAGTAGCCGGGACTACAGGCGCCCACCACCGTGCCCGGCTAATTTAGTTGT<br>ATTTTTAGTAGAGATGGGGTTTCACCGTATTAGCCAGGATGGTCTCGATCTCCTGACCTCGTG<br>ATCCGCCCGCCTCGGCCTCCCAAAGTGCTGGGATTACAGGCGTGAGCCACCGCGCCCGGCCT<br>GATTCTCTTAAAATTGAAGAGGTGCTGCCAAGGCCTTCAGATCTAACGCAGATGCATAGACCT<br>TGTTCCTGGTACTTGTTCAGCCTGTGCTGGGGAGCCGTGGTCCCGAGTTCCCTGGGAGGCTG<br>ACAGGGTCAAGCCACCCTGCCCACCACCCTCCCACTTCCCCTCCCCTTTCCTCTCCAGCATTAG<br>GATTCAAGGGAAATTTGCATGAAGCCAATTTTGAGGGTAGACGTGTGGGGAAAATAAATCAT<br>TATACAGTAAGACCTGGGGCTTGAGGGGTGGGGAATGGGAGGGAAGGGCATAGCCTGCT<br>CCTCCATGAGTCTGACATCTCGGAAACTGAGCAGCTGCCGGACGCCTGGGTCAGGAATCCAA |

TABLE 13-continued

Subtyping Target Sequences

| SEQ ID NO. | Gene | Affy Probeset ID | Sequence |
|---|---|---|---|
| | | | GACCCCACCTCTTAAGGACTGGTTCCTCAGAAAGCACCCTCAGGGAAAAAGGTGAAAACATT ACATCCGTGGATTCTCCTGCCACAACCGCATTGGAAGAAAAGGCTGCCGCAACATCTCAGCGA GGAGTGAAGGACCCATGTCCCAGGAACCGCGCTGCGCCACCTGCACTCACCCCCCTCACATTC TCTTAAGCACCCGGTGCCCTCCGAGGCCTGGCGGAATGGTGGTGCCCACGGGGTTGGGCA AGGGCTCACCAGGACCTCAACGGGCAAGTTGTGCACACTAAAATATCAAATCAAGGTGCTT GGTTTTAAAGTAAATGTTTTTCTAAAGAAAGCTGTGCTCTTCTGTTGACCCAGACGAATAGGG CACAGCCCTGTAACTGCACGTGCCTTCTG |
| 918 | MALL | 2570197 | TCCTGTACATGAGCGCTGCCGTCCTACAAGTACATGCCACGATTGTTTCTGAGAAACTGCTGG ACCCAAGAATTTACTACATTAATTCGGCAGCCTCG |
| 919 | MALL | 2570200 | ATGGTAGCCGCCACCCACATAGTATACCCCTTGCTGCAA |
| 920 | MALL | 2570204 | CCGCCACCAGCTACGCCCCGTCCGACGTGCCCTCGGGGGTCGCGCTGTTCCTCACCATCCCT |
| 921 | MALL | 2570205 | CTGTCTGCAGATAGCTTGGCTCATTGTTGGTCCTCAGTACGCAGCCCTCGTAGCCAAGCAGCT TGGGCCTACACTCTGGGCCCAGGGGAGTGGCTGTCGCTGGCATCCCCTGGAATAACATGCTC CGGGGGTCAAAGATTCCTTAGCTGGAAAGGTCTAGGAGGAGACTCCCGCTCTGCTCCCTCCT GCACCAGCGCTGTGCCCCCGCCGGCCAGGCAGAGCCATCCGATGCCGCTGGGCCGCCCACT GAGGATCTGCTGGCTGCAGCGAGTGGAAGGACCTGCTCGGCTGGAACGTTTTTTTTTTTTC CCTCCCAGGCGACGTCCGATGGGTGTGTCGGGCAGGAGGTGATATTTGACAGGCTGCGCGC |
| 922 | MALL | 2570235 | ATGAGGGGCTTCCAGCTGCTCTGTGCAG |
| 923 | FN1 | 2598262 | CCTGCAAGGGAAATAAAAATGACTAAGATATTA |
| 924 | FN1 | 2598263 | TAAAATTGCTAGTTTACCGTTCAGAAGTATAATAGAAATAATCTTTAGTTGCTCTTTTCTAACC ATTGTAATTCTTCCCTTCTTCCCTCCACCTTTCCTTCATTGAATAAACCTCTGTTCAAAGA |
| 925 | FN1 | 2598264 | TTTGATATAAGACACCTTCGGGGGAAATAATTCCTGTGAATATTCTTTTTCAATTCAGCAAACA TTTGAAAATCTATGATGTGCAAGTCTAATTGTTGATTTCAGTACAAGATTTTCTAAATCAGTTG CTACAAAAACTG |
| 926 | FN1 | 2598265 | ACTTAGTATGCAGTTGATAAGAGGAATTTGGTATAATTATGGTGGGTGATTATTTTTATACTG TATGTGCCAAAGCTTTAC |
| 927 | FN1 | 2598266 | TTGGGATCAATAGGAAAGCATATGCAGCCAACCAAGATGCAAATGTTTTGAAATGATATGAC CAAAATTTTAAGTAGGAAAGTCACCCAAACACTTCTGCTTTCACTTAAGTGTCTGGCCCGCAAT ACTGTAGGAACAAGCATGATCTTGTTACTGTGATATTTTAAATATCCACAGTACTCACTTTTTC CAAATGATCCTAGTAATTGCCTA |
| 928 | FN1 | 2598267 | GTTCTGCTTCGAAGTATTCAATACCGCTCAGTATT |
| 929 | FN1 | 2598268 | TGTTAGCAGACCCAGCTTAGAGTTCTT |
| 930 | FN1 | 2598269 | TCTCTGCCAAGATCCATCTAAACTGGAGTGA |
| 931 | FN1 | 2598270 | CTGACAGAGAAGATTCCCGAGAGTAA |
| 932 | FN1 | 2598271 | TGTTAATTGCCCAATTGAGTGCTTCATGCCTT |
| 933 | FN1 | 2598273 | GCTGTGACAACTGCCGCAGACCTGGGGGTGAACCCAGTCCCGAAGGCACTACTGGCCAGTCC TACAACCAGTATTC |
| 934 | FN1 | 2598274 | CTGACCTCCATGAGCTTGCTTTACCCCCTGCCAGCTTAAGAACAGTAGTGAAAGAGAACATGT GTGTCCTCCCATTTCCAGTAAAAACTTCAGGCAGGAGCCTCACTGGCTCAGCTTGGTCCCGTTT CCATCTCCCATGCCATCTCCGGCCAGGTGACAGGCTAC |
| 935 | FN1 | 2598275 | GCCAGGCTCCCTACAAGTTAGATAAGATAAAGGGTGGGCTCCTGCAAGGATGTGTCGTACAC ACAGGAGGGGCAGAGACCCTTCGGAAGTATTAAAATACCACATTTCCTGTTGGCATACAACT GCTGACATAGAGCTCTAGAGCAGCTCTATGTCTACCTTACATGCCATTCATTCTTTCTATTACTC TTAGTAGAAAGAATGAATGAATGGCATGTAGAGTACCAAAAACACAAGTCTTGAGTCATTCTT AATAGCAACACCTGTCATTTATATGATGTTAGAATCATTTTCCTAAGCTCCCTAGCATGTCAGA GATACTA |
| 936 | FN1 | 2598276 | TGATGGGAAGACATACCACGTAGGAGAACAGTGGCAGAAGGAATATCTCGGTGCCATTTGCT CCTGCACATGCTTTGGA |
| 937 | FN1 | 2598277 | GATGGTGCCATGACAATGGTGTGAACTA |
| 938 | FN1 | 2598280 | AAACTGTTGTGCCAGTGCTTAGGCTTTGGAAGTGGTCA |
| 939 | FN1 | 2598284 | CACTCTGACAGGCCTCACCAGAGGTGCCACCTACAACGTCATAGTGGAGGCACTGAAAGACC AGCAGAGGCATAAGGTTCGGGAAGAGGTTGTTACCGTGGGCAACTCTG |

TABLE 13-continued

Subtyping Target Sequences

| SEQ ID NO. | Gene | Affy Probeset ID | Sequence |
|---|---|---|---|
| 940 | FN1 | 2598286 | CAAGAAGCTCTCTCTCAGACAACCATCTCATGGGCCCCATTCCAGGACACTTCTGAGTACATC<br>ATTT |
| 941 | FN1 | 2598287 | AGGAAATCCAAATTGGTCACATCCCCAGGGAAGATGTAGACTATCACCTGTACCCACACGGTC<br>CGGGACTCAATCCAAA |
| 942 | FN1 | 2598288 | CACCCACCCTGGGTATGACACTGGAAATGGTATTCAGCTTCCTGGCACTTCTGGTCAGCAACC<br>CAGTGTTGGGCAACAAATGATCTTTGAGGAACATGGTTTTAGGCGGACCACACCGCCCACAA<br>CGGCCACCCCCATAAGGCATAGGCCAAGACCATACCCGC |
| 943 | FN1 | 2598289 | CTTCATGGACCAGAGATCTTGGATGTTCCTTCCA |
| 944 | FN1 | 2598290 | CCGGGAACCGAATATACAATTTATGTCATTGCCCTGAAGAATAATCAGAAGAGCGAGCCCCT<br>GATTGGAAGGAAAA |
| 945 | FN1 | 2598294 | CACACCCAATTCCTTGCTGGTATCATGGCAGCCGCCACGTGCCAGGATTACCGGCTACATCAT<br>CAAG |
| 946 | FN1 | 2598296 | TTACAACCAGGCACTGACTACAAGATCTACCTGTACACCTTGAATGACAATGCTCGGAGCTCC<br>CCTGTGGTCATCGACGCCTCCACTG |
| 947 | FN1 | 2598299 | CAAGAAGGGCTCGTGTGACAGATGCTACTGAGACCACCATCACCATTAGCTGGAGAACCAAG<br>ACTGAGACGATCACTGGCTTCCAAGTTGATGCCGTTCCAGCCA |
| 948 | FN1 | 2598301 | GTGAGTGTCTATGCTCTTAAGGACACTTTGACAAGCAGACCAGCTCAGGGAGTTGTCACCACT<br>CT |
| 949 | FN1 | 2598302 | CTATTCCTGCACCAACTGACCTGAAGTTCACTCAGGTCACACCCACAAGCCTGAGCGCCCAGT<br>GGACACCACCCAATGTTCAGCTCACTGGATATCGAGTGCGGGTGACCCCCAAGGAGAAGACC<br>GGACCAATGAAAGAAATCAACCTTGCTCCTGACAGCTCATCCGTGGTTGTATCAGG |
| 950 | FN1 | 2598303 | CAAACTCGGGCATTTCATAGCAGCATGATTCTGAGCACACGTGGGTAAGACCTTTCTTCTCTG<br>GTTAGATATCATATGCTGGTGTATAATTAGCTTAAATGATTGTGATTTAGCACCTAGGAAAT<br>AATCAATAGGGCAATTGCTTTCCATAATACTTTATCTTCTTGTGCTTTATTTCTGAAGCAGAGTA<br>GAATGCTAAAGATGTATCCTAGTGACAGCATAAACCCTAGAGGTGACAGTCTGTATTATTGCT<br>TTTCGCTTCTCTTTTCTGCTTCTGTTGGGAGCCAGTTTTCTTCTTACGCCGCATTACAGAGAGAA<br>CGTCAAATTTAGCAGCCATATCTGCCATAGGGTCCAAATAAAGAGACAATAAAAACATTATTC<br>TCTCTTTTTTGGATGGAATACTGCGTGAAATGGTTATCCATACAAAGATACTTTATGTAGAATA<br>GAAAAAGGAGGCCGGGTGCAGTGGCTCACACATGTAATCCTAGTGCTTTGGGAGGCTAAGC<br>CGGGAGCACTGATTGAGGCCAGGAGTTCATGATCAGCCTGGGCAATGAAGTGAGACCCCGT<br>CTCTACAAAAAAATATGAAAAAATTAGCGAGGTGTGGTGACACATGCCTGTAGTCCCAGCTAC<br>TCAAGAGGCTGAGGTAGAGGATCACTTGAGCCTACGAGTTCAAGGCTGCAGTGAGCTATGAT<br>AACTCCACTGCACTGCCGCCTGGATGACACAGAGAGACCGTTTCTAAATTAATTAATTAACAA<br>TTTTAAGAAAGAAAAAGGGCCATTGCTTATTTTTCCATACAAAAGTAAAATAAATCATAATGG<br>CCAATAAGCCAATGTAACTTTTTTTTTTAAGGGAAAGCAAAACTTGTAAAACCTAAAATCTCTT<br>AGAGTTTTGGCATTTACCCAAATGTTTTCAGTGATTCTGAGAATTGGTGGATATAAAACACATT<br>TCTCAGCAAACACTTTCTTCATTTTGCATCCCTTACTGTACGTACTTTCTTGTACTGAATCTTTGC<br>TTGACCAGGGAACC |
| 951 | FN1 | 2598304 | TGATCGCCCTAAAGGACTGGCATTCACTGATGTGGATGTCGATTCCATCAAAATTGCTTGGGA<br>AAGCCCACAGGGGCAAGTTTCCAGGTACAGGGTGACCTACTCGAGCCCTGAGGATGGAATCC<br>ATGAGCTATTCCCTGCACCTGATGGTGAAGAAGACACTGCAGAGCTGCAAGGCCTCAGACCG<br>GGTTCTGAGTACACAGTCAGTGTGGTTGCCTTGCACGATGATATGGAGAGCCAGCC |
| 952 | FN1 | 2598305 | GTCTGAATGCCCACGACATGTCTTTTGCAATTACACATAGGGAAAGTGAACTTGTTGGTTAGT<br>TTATGTCTTGAGCTGAGCCCTTTACGAACATCTTTTTTCCTTCTCAGTGCCAAGCGAGGAATTT<br>ACAGAGAAAGAAGTTGTGAAACCACCATAGTTAGTTGCTGTGCTTTGAATTTCTTTTGCTCAA<br>ATGGCCTCAGCGAAATCTTATTTGC |
| 953 | FN1 | 2598306 | GCCCACAGTGGAGTATGTGGTTAGTGTCTATGCTCAGAATCCAAGCGGAGAGAGTCAGCCTCT |
| 954 | FN1 | 2598307 | TTGACAAACCATCCCAGATGCAAGTGACCGATGTTCAGGACAACAGCATTAGTGTCAAGTGG<br>CTGCCTTCAAGTTCCCCTGTTACTGGTTACAGAGTAACCACCACTCCCAAAAATGGACCAGGA<br>CCAACA |
| 955 | FN1 | 2598308 | TGGGAGCAAGTCTACAGCTACCATCAGCGGCCTTAAACCTGGAGTTGATTATACCATCACTGT<br>GTATGCT |
| 956 | FN1 | 2598309 | TCTGTTGTGGATAACCTGAAAGCCCAACAGTGAACAAAGAATTAAAGAAACTTTGGCAAGTC<br>CATTCAACGGAGCCCTTGTTTTTTCCAAGAAAATACGTAAGATATAGATGATATAATTTGTTCT<br>AAAACCCAAATAAAAAGTTGTTTATATACTACAACTAGAGGGGGAACGGCAGAGCTGAGGAA<br>ATAAAAGGATTGTAAATTCACAAACATATTATCAGTGGTGGAAATAAGTGATTTTTATTTTTC<br>TTCTCTTTACTTTTCTGTATTTTCCAAATTTTATTTAAAAGGAATGTATTCTGTTAAAAGTTTTAA |

TABLE 13-continued

Subtyping Target Sequences

| SEQ ID NO. | Gene | Affy Probeset ID | Sequence |
|---|---|---|---|
| | | | AAAGGACACAATGCATGCAATCCTGGGTTGAGGGCTTACCTTCTCCCACTTCTAATGCTACTCT ACTACTCAGTGACATTTTAAAGCTGAAATGTTAAAACAGCGCTAACTGTAATTTTCTCTCAATG TTTATACACTTACCAAGGTTTGCTACATGCATA |
| 957 | FN1 | 2598310 | GGACCTGGAAGTTGTTGCTGCGACCCCCACCAGCCTACTGATCAGCTGGGATGCTCCTGCTGT CACAGTGAGATATTACAGGATCACTTACGGAGA |
| 958 | FN1 | 2598313 | CCAACTGGCATTGACTTTTCTGATATTACTGCCAACTCTTTTACTGTGCACTGGATTGCTCCTCG AGCCACCATCACTGGCTACAGGATCCGCCATCATCCCGAGCACTTCAGTGGGAGACCTCGAG AAGATCGGGTGCCCCACTCTCGGAATTCCATCACCCTCACCAACCTCACTCCAGGCACAGAGT ATGTGGTCAGCATCGTTGCTCTTAATGGCAGA |
| 959 | FN1 | 2598314 | CAGAATATGTAGTGAGTGTCTCCAGTGTCTACGAACAACATGAGAGCACACCTCTTAGAGGA AG |
| 960 | FN1 | 2598318 | CTGACCTGCGATTCACCAACATTGGTCCAGACACCATGCGTGTCACCTGGGCTCCACCCCCAT CCATTGATTTAACCAACTTCCTGGTGCGTTACTCACCTGTGAAAAATGAGGAAGATGTTGCAG AGTTGTCAATTTCTCCTTCAGACAATGCAGTGGTCTTAACAA |
| 961 | FN1 | 2598319 | TCACTGAATGGAACTGTAGCTCTAGATATCTCACATGGGGGAAGTTTAGGACCCTCTTGTCT TTTTGTCTGTGTGCATGTATTTCTTTGTAAAGTACTGCTATGTTTCTCTTTGCTGTGTGGCAACT TAAGCCTCTTCGGCCTGGGATAAAATAATCTG |
| 962 | FN1 | 2598320 | ACATAGATGGTGTTGCATGCTGCCACCAGTTACTCCGGTTAAATATGGATGTTTCATGGGGGA AGTCAGCAATTGGCCAAAGATTCAGATAGGGTGGATTGGGGGGATAAGGAATCAAATGCAT CTGCTAAACTGATTGGAGAAAAACACATGCAAGTATTCTTCAGTACACTCTCATTTAAACCACA AGTAGATATAAAGCTAGAGAAATACAGATGTCTGCTCTGTTTAAATATAAAATAGCAAATGTTC ATTCAATTTGAAGACCTAGAATTTTTCGTCTTAAATACCAAACACGAATACCAAATTGCGTAAG TACCAATTAATTATAAGAAATATATCACCAAAATGTACCATCATGATCTTCCTTCTACCCTTTGA TAAACTCTACCATGCTCCTTCTTTGTAGCTAAAAACCCATCAAAATTTAGGGTAGAGTGGATG GGCATTGTTTTGAGGTAGGAGAAAAGTAAACTTGGGAGCATTCTAGGTTTTGTTGCTGTCACT AGGTAAAGAAACACCTCTTTAACCACAGTCTGGGGACAAGCATGCAACATTTT |
| 963 | FN1 | 2598321 | TTGGGTACCGCATCACAGTAGTTGCGGCAGGAGAAGGTATCCCTATTTTTGAAGATTTTGTGG ACTCCTCAGTAGGATACTACACAGTCACAGGGCTGGAGCCGGGCATTGACTATGATATCAGC GTTATCACTCTCATTAATGGCGG |
| 964 | FN1 | 2598322 | CTTCAGATATTATGTCTAGGCTCTAAGAATGGTTTTGACATCCTAAACAGCCATATGATTTTTA GGAATCTGAACAGTTCAAATTGTACCCTTTAAGGATGTTTTCAAAATGTAAAAAATATATATAT ATATATATTCCCTAAAAGAATATTCCTGTTTATTCTTCTAGGGAAGCAAACTGTTCATGATGCT TAGGAAGTCTT |
| 965 | FN1 | 2598324 | GTGTCCCTATCTCTGATACCATCATCCCAG |
| 966 | FN1 | 2598325 | CCTACAAACGGCCAGCAGGGAAATTCTTTGGAAGAAGTGGTCCATGCTGATCAGAGCTCCTG CACTTTTGATAACCTGAGTCCCGGCCTGGAGTACAATGTCAGTGTTTACACTGTCAAGGATGAC |
| 967 | FN1 | 2598328 | GCAAACCCTGACACTGGAGTGCTCAC |
| 968 | FN1 | 2598330 | GAGGCACCACGAGAAGTGACTTCAGACTCAGGAAGCATCGTTGTGTCCGGCTTGACTCCAGG AGTAGAATACGTCTACACCATCCAAGTCCTGAGAGATGGACAGGAAAGAGATGCGCCAATTG TAAACAAAGT |
| 969 | FN1 | 2598331 | TCTATTCCACCTTACAACACCGAGGTGACTGAGACCACCATTGTGATCACATGGACGCCTGCT CCAAGAATTGGTTTTA |
| 970 | FN1 | 2598334 | GAAACTGATTCTACTGTCCTGGTGAGATGGACTCCACCTCGGGCCCAGATAACAGGATACCG ACTGACCGTGGGCCTTACCCGAAGAGGACAGCCCAGGCAGTACAATGTGGGTCCCTCTGTCT CCAAGTACCCACTGAGGAATCTGCAGCCTGCATCTGAGTACACCGTATCCCTCGTGGCCATAAA |
| 971 | FN1 | 2598338 | GACAGACGTGAAGGTCACCATCATGTGGACACCGCCTGAGAGTGCAGTGACCGGCTACCGTG TGGATGTGATCCCCGTCAACCTGCCTGGCGAGCACGGGCAGAGGCTGCCCATCAGCAGGAAC ACCTTTGCAGAAGTCACCGGGCTGTC |
| 972 | FN1 | 2598339 | TATTCGCCATCAGTAGAAGGTAGCAGCACAGAACTCAACCTTCCTGAAACTGCAAACTCCGTC ACCCTCAGTGACTTGCAACCTGGTGTTCAGTATAACATCACTA |
| 973 | FN1 | 2598340 | TGATGCCCCTCCTGACACGACTGTGGACCAAGTTGATGACACCTCAATTGTTGTTCGCTGGAG CA |
| 974 | FN1 | 2598342 | TCCAAGCACAGCCACTTCTGTGAACATCCCTGACCTGCTTCCTGGCCGAAAATACATTGTAAAT GTCTATCAGATATCTGAGGATGGGGA |

TABLE 13-continued

Subtyping Target Sequences

| SEQ ID NO. | Gene | Affy Probeset ID | Sequence |
|---|---|---|---|
| 975 | FN1 | 2598344 | ACAGGAGAGACGACTCCCTTTTCTCCTCTTGTGGCCACTTCTGAATCTGTGACCGAAATCACA GCCAGTAGCTTTGTGGTCTCCTGGGTCTCAGCTTCCGACACCGTGTCGGGATTCCGGGTGGAA TATGAGCTGAGT |
| 976 | FN1 | 2598345 | AGGCTCTCCTGAGGCAATGCTTTCCTTCTCAATTCATATTCTTCCAGGAGGGGCACCAACGTTT TTTAAAATGATGTTGGCGACGAGGACGGTAAATTTTCTAGATGACTGAAGGCTGACTTTCC |
| 977 | FN1 | 2598346 | TGGAAGGAAGCTACCATACCAGGCCACTTAAAACTCCTACACCATCAAAGGCCTGAAGCCTGGT GTGGTATACGAGGGCCAGCTCATCAGCATCCAGCAGTACGGCCACCAAGAAGTGACTCGCTT TGACTTCACCACCA |
| 978 | FN1 | 2598350 | ATCTTATCAATTCTGATGGTTTCTTTTTTTCCCAGCTTTTGAGCCAACAACTCTGATTAACTATTC CTATAGCATTTACTATATTTG |
| 979 | FN1 | 2598351 | GTGAGTATCCCACCCAGAAACCTTGGATACTGA |
| 980 | FN1 | 2598353 | GACGTTTTATCAAATTGGAGATTCATGGGAGAAGTATGTGCATGGTGTCAGATACCAGTGCT ACTGCTATGGCCGTGGCATTGGGGAGTGGCATTGCCAAC |
| 981 | FN1 | 2598354 | TGACATCACTTACAATGTGAACGACACATTCCACAAGCGTCATGAAGAGGGGCACATGCTGA ACTGTACATGCTTCGGTCAGGG |
| 982 | FN1 | 2598355 | GGCTTCTCACAGGAAAGTGTATTTTACCACATTCTTTACTTGAGCATACTGTAACCTCTGCAAA AGTTACACATTTTGGGAAGAAAAAAATTTTTTTGGCAAAAATTGTATTACTGACCAAACTTTGA AAAAAATGTTATTCTATGCTTGTAGAAAAGTTATTTTAGTGGAAGGTGTTGATAATTAAGTGG AAGTAGTTGTATGCTTTGAGAA |
| 983 | FN1 | 2598356 | GGAAATCTGCACAACCAATGAAGGGGTCATGTACCGCATTGGAGATCAGTGGGATAAGCAG CATGACATGGGTCACATGATGAGGTGCACGTGTGTTGGGAATGGTCGTGGGGAATGGACAT GCATTGCCTACTCGCAGCTTCGA |
| 984 | FN1 | 2598357 | CCTTCCTATACAACAACCACAATTACACTGATTGCACTTCTGAGGGCAGAAGAGACAACATGA AGTGGTGTGGGACCACACAGAACTATGATGCCGACCAGAAGTTTGGG |
| 985 | FN1 | 2598358 | CATCTTTGGTGCAGCACAACTTCGAATTATGAGCAGGACCAGAAATACTCTTTCTGCACAGAC CA |
| 986 | FN1 | 2598359 | TGGCAGGACGTTCTACTCCTGCACCACAGAAG |
| 987 | FN1 | 2598360 | CAGACTTACGGTGGCAACTCAAATGGAGAGCCATGTGTCTTACCATTCACCTACAA |
| 988 | FN1 | 2598362 | CCACTGTGTCACAGACAGTGGTGTGGTCTACTCTGTGGGGATGCAGTGGCTGAAGCACAAG GAAATAAGCAAATGCTTTGCACGTGCCTGGGCAACGGAGTCAGCTGCCAAGAGACA |
| 989 | FN1 | 2598363 | TCTGGCCCCTTCACCGATGTTCGTGCAGCTGTTTACCAACCGCAGCCT |
| 990 | FN1 | 2598367 | ATGCAACGATCAGGACACAAGGACATCCTATAGAATTGGAGACACCTGGAGCAAGAAGGAT AATCGAGGAAACCTGCTCCAGTGCATCTGCACAGGCAACGGCCGAGGAGAGTGGAAGTGTG AGAGGCACACCTCTGTGCAGA |
| 991 | FN1 | 2598371 | GACTTCCTATGTGGTCGGAGAAACGTGGGAGAAGCCCTACCAAGGCTGGATGATGGTAGATT GTACTTGCCTGGGAGAAGGCAGCGGACGCATCACTTGCACTTCTAGAA |
| 992 | FN1 | 2598372 | CCATGAAGGGGGTCAGTCCTACAAGATTGGTGACACCTGGAGGAGACCACATGAGACTGGT GGTTACATGTTAGAGTGTGTGTCTTGGTAATGGAAAAGGAGAATGGACCTGCAAGCCCAT AG |
| 993 | FN1 | 2598373 | ACACTTACCGAGTGGGTGACACTTATGAGCGTCCTAAAGACTCCATGATCTGGGACTGTACCT GCATCGGGGCTGGGCGAGGGAGAATAAGCTGTACCATC |
| 994 | FN1 | 2598374 | ATCAACAGTGGGAGCGGAACCTACCTAGGCAATGCGTTGGTTTGTACTTGTTATGGAGGAAGC CGAGGTTTTAACTGCGAGAGTA |
| 995 | FN1 | 2598375 | GAGGCAGGCTCAGCAAATGGTTCAGCCCCAGTCCCCGGTGGCTGTCAGTCAAAG |
| 996 | FN1 | 2598376 | GCGACAACCCCCGGGAGGCATTAGAAGGGATTTTTCCCGCAGGTTGCGAAGGGAAGCAAAC TTGGTGGCAACTTGCCTCCCGGTGCGGGCGTCTCTC |
| 997 | FN1 | 2598377 | GACCGTCCCATATAAGCCCCGGCTCCCGGCGCTCGGACGCCCGCGCCGGCTGTGCTGCA |
| 998 | PPARG | 2611057 | CCTGGGGCGCTTGGGTCGGCCTCGAGGACACCGGAGAGGGGCGCCACGCC |

TABLE 13-continued

Subtyping Target Sequences

| SEQ ID NO. | Gene | Affy Probeset ID | Sequence |
|---|---|---|---|
| 999 | PPARG | 2611059 | AGTCGTGGTACTTTACGCCTCGGTGTTTAGGGAGGAGCCTAAGGTAAGGAGTCAGAAACGG GGAGTAACCGAGCTGCGGCTTTTATATAAGGTCAGTGGTAGGTAAGGAAGGGGCCTTAACCT CTGCTGGTGACCAGAAGCCTGCATTTC |
| 1000 | PPARG | 2611073 | GTGTAGGAAGAATGTTTATTTTTCAG |
| 1001 | PPARG | 2611074 | TTAGAGAAGCAGCAAATAGCGAAGAAA |
| 1002 | PPARG | 2611080 | ACAGCAAACCCCTATTCCATGCTGTT |
| 1003 | PPARG | 2611081 | CTCTGGGAGATTCTCCTATTGACCCAGAAAGCGATTCCTTCACTGATACACTGTCTGCAAACA |
| 1004 | PPARG | 2611086 | CCAACTTTGGGATCAGCTCCGTGGATCTCTCCGTAATGGAAGACCACTCCCACTCCTTTGATAT CAAGCCCTTCACTACTGTTGACTTCTCCAGCATTTCTACTCCACATTACGAAGCATTCCATTCA CAAGAACAGATCCAGTGGTTGCAGATTACAAGTATGA |
| 1005 | PPARG | 2611087 | GTGCAATCAAAGTGGAGCCTGCATCTCCACCTTATTATTCTGAGAAGACTCAGCTCTACAATA AGCCTCATGAAGAGCCTTCCAACTCCCTCATGGCAATTGAATGTCGTGTCTGTGGAGATAAAG CTTCTGGATTTCACTATGGAGTTC |
| 1006 | PPARG | 2611089 | TTTCTTCCGGAGAACAATCAGATTGAAGCTTATCTATGA |
| 1007 | PPARG | 2611090 | GATGTGATCTTAACTGTCGGATCCACAAAAAAAGTAGAAATAAATGTCAGTACTGTCGGTTTC AGAAATGCCTTGCAGTGGGGATGTCTCATAAT |
| 1008 | PPARG | 2611094 | CTGTTGGCGGAGATCTCCAGTGATATCGACCAGCTGAATCCAGAGTCCGCTGACCTCCGGGC CCTGGCAAACATTTGTATGACTCATACATAAAGTCCTTCCCGCTGACCAAAGCAAAG |
| 1009 | PPARG | 2611095 | TAAATGGTTTACTGCGCTACAAATGCACACACAGAATATTGTTCAACTGTTGGCTGTTAACATA TTGCAGGCTGAGTCTGAAACGCAGGAAGTGTTTTCAGATAGCACAAGTCAACATTATTTTGAA AAGGGAGAAAAGTCCATAAAGTTTTTGAGAATAGTGTAACAATGTATTGGTCATCCTAACTTT AATGAATGAACTTAAGCCCCCTGAGCCTATCACCCTCTTTTAGG |
| 1010 | PPARG | 2611101 | TGGAGTCCACGAGATCATTTACACAATGCTGGCCTCCTTGATGAATAAAGATGGGGTTCTCAT ATCCGAGGGCCAAGGCTTCATGACAAGGGAGTTTCTAAAGAGCCTGCGAAAGCCTTTTGGTG ACTTTA |
| 1011 | PPARG | 2611111 | GACAACCTGCTACAAGCCCTGGAGCTCCAGCTGAAGCTGAACCACCCTGAGTCCTCACAGCTG TTTGCCAAGCTGCTCCAGAAAATGACAGACCTCAGACAGATTGTCACGGAACACGTGCAGCT ACTG |
| 1012 | PPARG | 2611112 | GTGATCAAGAAGACGGAGACAGACATGAGTCTTCACCCGCTCCTGCAG |
| 1013 | PPARG | 2611113 | TCCAGTTGCACTATTCTGAGGGAAAATCTGA |
| 1014 | TMEM45A | 2633692 | CCAAAGAAGCGACTAGGGACCCAAGTTTAAAAATTCCTCCCCCCACCCAATGCGAGACGTGG CCAGATCCCATCCAACACACGGTTTAATTTTCATGGGGCTCTGGGATCAAAAGAACAGAAACA GCAACAACAAAAGCCCAGCCGCTGTCTGATTTTAAGCT |
| 1015 | TMEM45A | 2633698 | GAGCATTAAGCAGTATCTCCCAGCATTGTTAGCTACTGAGTGGCACATCTTCAGTACGCATGA TTCGTGGGG |
| 1016 | TMEM45A | 2633699 | AACTTTTCAGCATTACCTAAGAAGCAAAGGC |
| 1017 | TMEM45A | 2633700 | TTCTAACGTGCCTGATCTACTGAGACCAAGGATGACCAATGACTCAGAAG |
| 1018 | TMEM45A | 2633706 | AGAGGTCATGCCCTCCCTGGAACCTTCTTTTTTATTATTGGTCTTTGGTGGTGTACAAAGAGTA TTCTGAAGTATATCTGCAAAAAGCAAAAGCGAACCTGCTATCTTGGTTCCAAAACATTATTCTA TCGATTGGAAATTTTGGAGGGAATTACAATAGTTGGCATGGC |
| 1019 | TMEM45A | 2633707 | TAAACAAGGTCACTGGAATCAACTCCTGGG |
| 1020 | TMEM45A | 2633708 | TTGGGTGTGGCAGATATCTTATGTTTCACCATCAGTTCACTTCCTGTGTCCTTAACCAAGTTAA TGTTGTCAAATGCC |
| 1021 | TMEM45A | 2633710 | ACTCATGGCCGGGAAATGCTGGACATCTTTGTGCACCAGCTGCTGGTTTTGGTCGTCTTTCTG ACAGGCCTCGTTGCCTTCCTAGAGTTCCTTGTTCGGAACAATGTACTTCTGGAGCTATTGCGGT CAAGTCTCATTCTGCTTCAGGGG |
| 1022 | TMEM45A | 2633712 | TTGGATTTGTCCTGTATCCCCCAGTGGAGGTCCTGCATGGGATCTGATGGATCATGAA |
| 1023 | TMEM45A | 2633715 | GCTGACTTCTGGGCCTCATCTCCTTAG |

TABLE 13-continued

Subtyping Target Sequences

| SEQ ID NO. | Gene | Affy Probeset ID | Sequence |
|---|---|---|---|
| 1024 | TMEM45A | 2633716 | GCCAGCATCCAAGGAAATGCTCTTCCTCATGTCAGCTCCCCTCCAGAGCCAAAAGAAGACTAC<br>TGTCTCTTCCTGTTTCAAAACGCTTCATACCCCTAATGGGCCTCTTATCCACTTATA |
| 1025 | TMEM45A | 2633717 | CCTCCACCTGGCATATTCACATTAAATGCACGTCTTTTCTATGAAAACTTCTGTGGTGACTCTA<br>GCTCTTGCTCATCTCCCTTTAAGAGTTTTTGTTTTTTTTTCAAATACACCACAAAAGATTTTATT<br>ATGAAAAACATATGGGTAAAATGTAGCAACTATGCGGTTTACAAAATGTTCTATTATTGCATA<br>AAACTATCTTTGGTCTATCACCTTCTAAAACTTCTTACACTCTTTCTTGGTGTTAGGTCAAATCT<br>GCAAATGCTTTATCTGTTCTCCATATCATTAGAGCTCCATCTTCCACAAATATTTTAAGATAGAC<br>CTTCCCTCCACAATCATTACTCCCACAGTCTTAATGTAACCAGTGAACATGGACAGCAGCCGTC<br>CAATATACATTCACA |
| 1026 | TMEM45A | 2633718 | CAACAAGTATTGTTTACTGCACATATATAAAGATGATTTAATATTGAAAAATTTATTAATTAAA<br>TGCACCCTAATGATAGGTCCAGTTTCTTATGATTAAGAAACACCATAAGGTGATCTTAATAGCT<br>ACTTAAGAAACATTCGATACAATTTAAACTGATTTGTTTACCTCTTAGAAAACAAGAATGAAGT<br>TTTTGTATGATAAGCAATATTCTTTTTTTAAAAATTTTATTATTATTATACTTTAAGTTTTAGGGT<br>ACATGTGCACAACATGCAGGTTTGTTACATATGTATACATGTGCCATGTTGGTGTGCTGCACC<br>CGTTAACTCATCATTTAGTGTTAGGTATATCTCCTAATGCTATCCCTCCCCCCTATCGACACCCC<br>ACAACAGTCCCCGGTGTGTGATGTTCCCCTTCTTGTGTCCATGTGTTCTCATTGTTCAATTCCCA<br>CCTATGAGTGAGAATATGCGGTGTTTGGTTTTTTGTTCTTGCGATAGTTTGCTGAGAATGATG<br>GTTTCCAGTTTCATCCATGTCCCTACAAAGGACATGAACTCATCATTTTTTATGGCTGCATAGT<br>ATTCCATGGTGTATATGTGCCACATTTTCTTAATCCAATCTATCGTTGTTGGACATTTAGGTTG<br>GTTCCAAGTCTTTGCTATTGTGAATAGTGCCACAGTAAACATACATGTGCATGTGTCTTTATAG<br>CAGCATGATTTATAATCCTTTGGGTATATACCCAGTAATGGGATGGCTGGATCAAATGGTATT<br>TCTAGTTCTAGATCCCTGAGGAATCGCCACACTGACTTCCACAATGGTTGAACTAGTTTACAGT<br>CCCACCAACAGTGTAAAAGTGTTCCTATTTCTCCACAACCTCTCCAGCACCTGTTGTTTCCTGAC<br>TTTTTAATGATCGCCATTCTAACTGGTGTGAGATGGTATCTCATTGTGGTTTTGATTTGCATTTC<br>TCTGATGGCCAGTGATGGTGAGCATTTTTTCATGTGTTTTTTGGCTACATAAATGTCTTCTTTTG<br>AGAAGTGTCTGTTCATATCCTTCGCCCACTTTTTGATGGGGTTGTTTGTTTTTTTCTTGTAAATT<br>TGTTTGAGTTCATTGTAGATTCTGGATACTAGCCCTTTGTCAGATGAGTAGGTTGTGAAAATTT<br>TCTCCCATTCTGTAGGTTGCCTGTTCACTCTCATGGTAGTTTCTTTTGCTGTGCAGAAGCTCTTT<br>AGTTTAATTAGATCCCATTTGTCAATTTTGTCTTTTGTTGCCATTGCTTTTGGTGTTTTCGACAT<br>GAAGTCCTTGCCCATGCCTATGTCCTGAATGGTATTGCCTAGGTTTTCTTCTAGGGTTTTTATG<br>GTTTTAGGTCTAACATGTAAGTCTTTAATCCATCTTGAATTAATTTTTGTATAAGGTGTAAGGA<br>AGGGATCCAGTTTCAGCTTTCTACATATGGCTAGCCAGTTTTCCCAGCACCATTTATTAAATAG<br>GGAATCCTTTCCCCATTGCTTGTTTTTCTCAGGTTTGTCAAAGATCAGATAGTTGTAGATATGT<br>GGCATTATTTCTGAGGGCTCTGTTCTGTTCCATTGGTCTATATCTCTGTTTTGGTACCAGTACCA<br>TGCTGTTTTGGTGACTGTAGCCTTGTAGTATAGTTTGAAGTCAGGTAGCATGATGCCTCCAGC<br>TTTGTTCTTTTGGCTTAGGATTGACTTGGCGATGCGGCTCTTTTTTGGTTCCATATGAACTTTA<br>AAGCAGTTTTTTCCAATTCTGTGAAGAAAGTCATTGGTAGCTTGATGGGGATGGCATTGAATC<br>TATAAATTACCTTGGGCAGTATGGCCATTTTCACGATATTGATTCTTCCTACCCATGAGCATGG<br>AATGTTCTTCCATTTGTTTGTATCCTCTTTTATTTCCTTGAGCAGTGGTTTGTAGTTCTCCTTGAA<br>GAGGTCCTTCACATCCCTTGTAAGTTGGATTCCTAGGTATTTTATTCTCTTTGAAGCAATTGTG<br>AATGGGAGTTAATTCATGATTTGGCTCTCTGTTTGTCTGTTATTGGTGTATAAGAATGCTTGCG<br>ATTTTTGTACATTGATTTTGTATCCTGAGACTTTGCTGAAGTTGCTTATCAGCTTAAGGAGCTTT<br>TGGGCTGAGCTGATGGGGTTTTCTAGATATACAATCACGTCATCTGCAAACAGGGACAATTTG<br>ACCTCCTGTTTTCCTAATTGAATACCCTTTATTTCCTTCTCCTGCCTGATTGCCCTGGCCAGAAC<br>TTCCAACACTATGTTGAATAGGAGTGGTGAGAGAGGGCATCCCTGTCTTGTGCCAGTTTTCAA<br>AGGGAATGCTTCCAGTTTTTGCCCATTCAGTATGGATATTGGCTATGGGTTTCATAGATAGCTTT<br>TATTATTTTGAGATACGTCCCATCAATACCTAATTTATTGAGAGTTTTTAGCATGAAGGGTTGT<br>TGAATTTTGTCAAAGGCCTTTTCTGCATCTATTGAGATAATCATGTGGTTTTTGTCGTTGGTTCT<br>GTTATATGCTGGATTACATTTATTGATTTGTGTATGTTGAACCAGCCTTGCATCCCAGGGATGA<br>AGCCCACTTGATCATGGTGGATAAGCTTTTTGATGTGCTGCTGGATTCGGTTTGCCAGTATTTT<br>ATTGAGGATTTTTGCATCCATGTTCATCAAGGATATTGGTCTAAAATTTTCTTTTTTGGTTATGT<br>CTCTGCCAGCCTTTGGTATCAGGATGATGCTGGCCTCATGAAATGAGTTAGGGAGGATTCCCT<br>CTTTTTCTATTGATTGGAATAGTTTCAGAAGGAATGGTACAAAAAACCTTTCAAAAAATTAATG<br>AATCCAGGAGCTGGTTTTTGAAAACATCAACAAAATTGATAGACTGCTAGCAAGACTAATAA<br>AGAAGAAAAGAGAAGAATCAAATAGAGCAATAAAAAATGATAAAGGGGATGTCACCAC<br>CGATCCCACAGAAATACAAACTACCATCAGAGAGTACTATAAACACCTGTATGCAAATAAACT<br>AGAAAATCCTGAAGAAATGGATAAATTCCTCGACACATACATCCTCCCAAGACTAAACCAGGA<br>AGAAGTTGAATCTCTGAATAGACCAATAACAGGCTCTGAAATTGAGGCAATAATCAATAGCTT<br>ACCAACCAAAAAAGTCCAGGACAGATGGATTCACAGCCGAATTCTACCAGAGGTCCCTCC<br>AAGAATTTTTACAGCCCGTCGTCTTCACCATGCATTTTAACAATTGGGATCTCTCCTGTGATGT<br>TCACTATTAGGTC |
| 1027 | TMEM45A | 2633720 | TTGGTTAAATCTAGACTTAAGAGGCTCTGCTCCTCAGAAGTTGGACTTCTGAAAAATGCTGAA<br>CGAGAACAAGAATC |
| 1028 | TMEM45A | 2633721 | TGGCTAAGGATGACTCTAAGTGTACTGTTTGCATTTCCAATTTGGTTAAAGTATTTGAATTTAA<br>ATATTTTCTTTTTAGCTTTGAAAATATTTTGGGTGATACTTTCATTTTGCACATCATGCACATCA<br>TGGTATTCAGGGGCTAGAGTGATTTTTTTCCAGATTATCTAAAGTTTGGATGCCCACACTATGA<br>AAGAAATATTTGTTTTATTTGCCTTATAGATATGCTCAAGGTTACTGGGCTTGCTACTA |
| 1029 | UPK1B | 2637835 | ATCCTACCTTAAGTTGAAGCAGACCAGCAATTGTTGTGACCTACAATCTCCACACCCATCTT |

TABLE 13-continued

Subtyping Target Sequences

| SEQ ID NO. | Gene | Affy Probeset ID | Sequence |
|---|---|---|---|
| 1030 | UPK1B | 2637838 | TGCCTTCAGCTTGTGGGAAATCCCGAAG |
| 1031 | UPK1B | 2637839 | ATGGCCAAAGACAACTCAACTGTTCGTTGCTTCCAGGGCCTGCTGATTTTTGGAAA |
| 1032 | UPK1B | 2637841 | CCCTGACTGCGGAGTGCATCTTCTTTGTATCTGACCAACACAGCCTCTACCCACTGCTTGAAGCCACCGACAACGATGACATCTATGGGGCTGCCTGGATCGGCATATTT |
| 1033 | UPK1B | 2637842 | GCATCTTGTATCACAGCAGCAACAC |
| 1034 | UPK1B | 2637843 | TAGAGAGGTACCAAAACAACAGCCCTCCAAACAATGATGAC |
| 1035 | UPK1B | 2637844 | GACAATTGCTGTGGCGTAAATGGTCCATCAGACTGGCAAAAATACACATCTGCCTTCCGGACTGAG |
| 1036 | UPK1B | 2637845 | TGCTGACTATCCCTGGCCTCGTCAATGCTGTGTTATGAACAATCTTAAAGAACCTCTCAACCTGGAGGCTTGTAAACTAGGCGTGCCTGGT |
| 1037 | UPK1B | 2637848 | GCTGCTATGAACTGATCTCTGGTCCAATGAACCGACACGCCTGGGGGGT |
| 1038 | UPK1B | 2637850 | GGGTTCTCCTGGGTACCATGTTCTACTGGAGCAGAATTGAAT |
| 1039 | UPK1B | 2637851 | GCTCTCTCCTAATATTCCACGTTTGTGCCCCACACTAACGTGTGTGTCTTACATTGCCAAGTCAGATGGTACGGACTTCCTTTA |
| 1040 | UPK1B | 2637852 | TTGGCTAGCAATCTGCCTGTATCTCTCACTATTATCTAAAAGAAACCTTCCAATGCTTCTGTTGATCTCAGTATTGTCAGGGGAACAGAGAAGTTGGGAAAAGATTACTGAAATATACCTTTTGCATTTCTTTCTAGAGTAGCTCCCATATATGGAGATGGGTGATTCTCTTGATGCCACCTTCAGATCCTTTTATTCTCCAGAATAATTCTTAACAGTGGTTCAAATTTCCTTTCATACCTTGAAGTATGTGTTTAGTAGCCTCAATTCTCCATTAATTAAAAGTGTGGGCTGGGCGTGGGGGCTCATGCCTGTAATCCCAGCACTTTGGGAGGCCGAGGTGGGCAGATCACCTGAGGTCAGGAGTTCAAGACCAGCCTGGCCAACATGGTGAAACCCCGTCTCTACAAAAATACAAAAATTAGCCAGGCGTGATGGCAGGTGCCTGTAATCCTAGCTACTTGGCAGGCTAACGCAGGAGAATCACTTGACCGGGAGACGAGGTTGCAGTGAGCTGAGATCGTACCTATTGCACTCCATCCTGGATGAAAGAGCCAGACTCTGTCTCAAAACAAACAAAAAAGCGTGGGGACTTCTGGGGACAGACAAGGTGCCTGTTATATATTTACTCAGTCTTTGCCCTGAATGGTCTCAGCTTGAGACCATTTCAAACTGGAGAGAAGCAAGCCAGCCAATAGAATGGGGTGATTTACAGGGATTTCTGTTTACTGTCAAAA |
| 1041 | CSTA | 2638872 | CATCCTGTCCAGCAAAGAAGCAATCAGCCAAA |
| 1042 | CSTA | 2638873 | TGGAGGCTTATCTGAGGCCAAACCCGCCACTCCAG |
| 1043 | CSTA | 2638876 | ACAAATGAGACTTACGGAAAATTGGAAGCTGTGCAGTATAAAACTCAAGTTGTTGCTGG |
| 1044 | CSTA | 2638877 | GAGTTCAGCACCTACTTTAGCGCCAAAAGATGTATTTCTCATTTTATGTAAAATATTCCCTGATTTCCCTACCACATAATTCCTTCCTTACGGTTGTCCTAAATTAAGATGCCCAGCATGATTCCTTCCAAGTGGTGGACTCTCAAATTTGGTAGATGATGTGACACCATTTTTTTTCTTGTGAATTCAGAAGTTTTATTACATTGATTCTTGATTTCTGGAAATTGTATAGAAAAGATTTCATAACAGTTCAGGGCATGCTGGATTTGTGGCTGTGCTGCTGCTTAGGTAAGGAGGGAGGATCACGTCTCATCTGCCTGAAGGTGTGGGGCTGGACCACATGGTATCTTGAAGCTGATTCTACCTCAAAGCTGTATGATTCTCTATGTCTAAATTAAATAAATTAAGTAACGACTCAAATCATTAGCTGGGAAAATAATTTAAACCTTTTTTGCCCTTCAATTAATATAATGTAAATACTATTTTGTAACTCAAATTAGATTTAACTTGTGGCACTCTAGGCATAGTTTA |
| 1045 | CSTA | 2638879 | CAAAAGTCTTCCCGGACAAAATGAGGACTTGGTACTTACTGGATACCAGGTTGACAAAAACAAGGATGACGAGCTGACGGGCTTTTA |
| 1046 | CSTA | 2638880 | AAGTGTTCTGATTCCTTCAACTGGCTACTGAGTCATGATCCTTGCTGATAAATATAACCATCAATAAAGAAGCATTCTT |
| 1047 | CSTA | 2638881 | GTCAAGCCTAATGCAACTGGCTAAAGGATAGTACCACCCTCACCCCCACCATAGGCAGGCTGGATCGTGGACTATCAATTCACCAGCCTCCTTG |
| 1048 | RALBP1 | 2654257 | TGCAGGAATTCCAGCGTTTACTCAAAGAACTGCCAGA |
| 1049 | KRT18 | 2698437 | GCCCAGGAGTATGAGGCCCTGCTGAACATCAAG |
| 1050 | RARRES1 | 2702753 | TGTGTTGAATGTTCTCGTGAAGATTTGTATACAAAGGAAAAATTTGTGCTAAACTGGAATTAAATGAATGGTAATATTGCTTAACTTAAATTTTACAAATAATAGAACGTCTGTCTCACCAGATAAAGCTGTCTGCAAACATGCATCAAAAG |
| 1051 | RARRES1 | 2702754 | TTTTAACTCTGGAAGCGCATGCACACTGAACTCTGCTCAGTGCTAAACAGTCACCAGCAGGTTCCTCAGGGTTTCAGCCCTAAAATGTAAAACCTGGATAATCAGTGTATGTTGCACCAGAATCAGCATTTTTTTTTTAACTGCAAAAAATGATGGTCTCATCTCTGAATTTATA |

TABLE 13-continued

Subtyping Target Sequences

| SEQ ID NO. | Gene | Affy Probeset ID | Sequence |
|---|---|---|---|
| 1052 | RARRES1 | 2702755 | CCTGTCGCATTCACTTGGTCTGGTACCCTGGCAAACCTCTTAAAGTGAAGTACCACTGTCAAG AGCTACAGACACCAGAAGAAGCCTCCGGAACTGAAGAAGGATCAGCTGTAGTACCAACAGA GCTTAGTA |
| 1053 | RARRES1 | 2702756 | GATGATACAATTGATTTTGATTATAC |
| 1054 | RARRES1 | 2702757 | GTGACAGACATTCAACCAGACTTTCATATAACTCAGTGACAAGACAA |
| 1055 | RARRES1 | 2702760 | ACTTGTGCCACAAGAGTTACAATCAAAGTGGTCTCCTTAGACTGAATTCATGCGAACTTCTAAT TTCATATCAAGAGTTGTAATCACATTT |
| 1056 | RARRES1 | 2702761 | GGCTTTCCTTGGAAGCTCTTACGTGATGTGGGAAATGACAACACAGGTGTCACACTACTACTT GGCACAGCTCACTAGTGTG |
| 1057 | RARRES1 | 2702764 | GGACGTTTGGGGAAATGTTCTGCTCGAGTGTTTTTCAAGAATCAGAAACCCAGACCAACCATC AATGTAACTTGTACACGGCTCATCGAGA |
| 1058 | RARRES1 | 2702767 | TCCAAAAGAGGGATGTAAAGTTCACGTGGTCTTCAGCACAGAGCGCTACAACCCAGAG |
| 1059 | RARRES1 | 2702775 | GCGCGCGGCGCTTCACTTCTTCAACTTCCGGTCCGGCTCGCCCAGCGCGCTACGAGTGCTGGC CGA |
| 1060 | RARRES1 | 2702776 | CCTCAGGATGCTGGGGTCCCGCGCAG |
| 1061 | RARRES1 | 2702777 | CGCCGGCAACGGCTGCCTGCTCCCTGGTCCGGGCCCAGGGGCCCGCGCCCCACCGCCCCGCT GCTCGCGCTGCTGCTGTTGCTCGCCCCGGTGGCGGC |
| 1062 | CLDN1 | 2710603 | CTCATAAGGTGCTATCTGTTCAGTGATGCCCTCAGAGCTCTTGCTGTTAGCTGGCAGCTGACG CTGCTAGGATAGTTAGTTTGGAAATGGTACTTCATAATAAACTACACAAGGAAAGTCAGCCAC TGTGTCTTATGAGGAATTG |
| 1063 | CLDN1 | 2710604 | GCCTTAACCAGTCTCTCAAGTGATGAGACAGTGAAGTAAAATTGAGTGCACTAAACAAATAA GATTCTGAGGAAGTCTTATCTTCTGCAGTGAGTATGGCCCGATGCTTTCTGTG |
| 1064 | CLDN1 | 2710605 | AGCTTTGGGTGCCTTTGCCACAAGACCTAGCCTAATTTACCAAGGATGAATTCTTTCAATTCTT CATGCGTGCCCTTTTCATATACTTATTTTATTTTTTACCATAATCTTATAGCACTTGCATCGTTAT TAAGCCCTTATTTGTTTTGTGTTTCATTGGTCTCTATCTCCTGAATCTAACACATTTCATAGCCT ACATTTTAGTTTCTAAAGCCAAGAAGAATTTATTACAAATCAGAACTTTGGAGGCAAATCTTTC TGCATGACCAAAGTGATAAATTCCTGTTGACCTTCCCACACAATCCCTGTACTCTGACCCATAG CACTCTTGTTTGCTTTGAAAATATTTGTCCAATTGAGTAGCTGCATGCTGTTCCCCCAGGTGTT GTAACACAACTTTATTGATTGAATTTTTAAGCTACTTATTCATAGTTTTATATCCCCCTAAACTA CCTTTTTGTTCCCCATTCCTTAATTGTATTGTTTTCCCAAGTGTAATTATCATGCGTTTTATATCT TCCTAATAAGGTGTGGTCTGTTTGTCTGAACAAAGTGCTAGACTTTCTGGAGTGATAATCTGG TGACAAATATTCTCTCTGTAGCTGTAAGCAAGTCACTTAATCTTTCTACCTCTTTTTTTCTATCTGC CAAATTGAGATAATGATACTTAACCAGTTAGAAGAGGTAGTGTGAATATTAATTAGTTTATAT TACTCTCATTCTTTGAACATGAACTATGCCTATGTAGTGTCTTTATTTGCTCAGCTGGCTGAGA CACTGAAGAAGTCACTGAACAAAACCTACACACGTACCTTCATGTGATTCACTGCCTTCCTCTC TCTACCAGTCTATTTCCACTGAACAAAACCTACACACATACCTTCATGTGGTTCAGTGCCTTCCT CTCTCTACCAGTCTATTTCCACTGAACAAAACCTACGCACATACCTTCATGTGGCTCAGTGCCT TCCTCTCTCTACCAGTCTATTTCCATTCTTTCAGCTGTGTCTGACATGTTTGTGCTCTGTTCCATT TTAACAACTGCTCTTACTTTTCCAGTCTGTACAGAATGCTATTTCACTTGAGCAAGATGATGTA ATGGAAAGGGTGTTGGCATTGGTGTCTGGAGACCTGGATTTGAGTCTTGGTGCTATCAATCA CCGTCTGTGTTTGAGCAAGGCATTTGGCTGCTGTAAGCTTATTGCTTCATCTGTAAGCGGTGG TTTGTAATTCCTGATC |
| 1065 | CLDN1 | 2710606 | CGAAAATGGACATTGAGATACTATCATTAACATTAGGACCTTAGAATTTTGGGTATTGTAATC TGAAGTATGGTATTACAAAACAAACAAACAAACAAAAAACCCATGTGTTAAAATACTCAGTGC TAAACATGGCTTAATCTTATTTTATCTTCTTTCCTCAATATAGGAGGGAAGATTTTTCCATTTGT ATTACTGCTTCCCATTGAGTA |
| 1066 | CLDN1 | 2710607 | TCTTACCCAACACCAAGGCCCTATCCAAAACCTGCACCTTCCAGCGGGAAAGACTA |
| 1067 | CLDN1 | 2710609 | GTTGCCACAGCATGGTATGGCAATAGAATCGTTCAAGAATTCTATGACCCTATGACCCCAGTCA |
| 1068 | CLDN1 | 2710611 | TTGGCATCCTCCTGGGAGTGATAGCAATCTTTGTGGCCACCGTTGGCATGAAGTGTATGAAGT GCTTGGAAGACGATGAGGTGCAGAAGATGAGGATGGCTGTCATTGGGGGTGCGATATTTCTT CTTG |
| 1069 | CLDN1 | 2710612 | GCACATTGCAAGCAACCCGTGCCTTG |
| 1070 | CLDN1 | 2710618 | TTGGGCTTCATTCTCGCCTTCCTGGGATGGATCGGCGCCATCGTCAGCACTGCCCTGCCCCAG TGGAGGATTTACTCCTATGCCGGCGACAACATCGTGACCGCCCAGGCCATGTACGAGGGGCT GTGGATGTCCTGCGTGTCGCAGAGCACCGGGCAGATCCAGTGCAAAGTCTTTGACTCCTTGCT GAATCTGAGC |

TABLE 13-continued

Subtyping Target Sequences

| SEQ ID NO. | Gene | Affy Probeset ID | Sequence |
|---|---|---|---|
| 1071 | CLDN1 | 2710619 | TGCGTCTCAGTTCCCGAGCCTGGGAGCAACCGCAGCTTCTAGTATCCAGACTCCAGCGCCGCC CCGGGCGCGGACCCCAACCCCGACCCAGAGCTTCTCCAGCGGCGGCGCAGCGAGCAGGGCT CCCCGCCTTAACTTCCTCCGCGGGCCCAGCCACCTTCGGGAGTCCGGGTTGCCCACCTGCAAA |
| 1072 | S100P | 2717083 | TCCTCTTGGTCTGTGAGCATCCAGCCTTACTTTTTGTATCCAATCATATTTCCATACTTCGCTGAA CTGTGTTTATGGATAGTTTCCACCAGATCTTTGGATCTTCATCTTGAAGGCTGCCGTGCCACAT AAGCTATGATCAAATACATCTGTTATGCTCTTCTCCTATTCATCTGCCTTCTGCCCGTTGATTTT CAGCAAACTCCCAGAGGATGAAGGGGAGTTTTCTGTTTGGCCCCACAGGGGAGGAGCGAGC GAGATTGACGTGGAAGCTGGGCCTCTGAAGGACACAGAGTGCTCTAAGAAAGGGACGATGG GGCAGATCCATGTTCACAAACACGCCCATGTGAATTCACTCTCAGATGTCTCCTCGTGTCAGC ACGCTGGGTGCCAGCACGCTCTGATATTGACA |
| 1073 | S100P | 2717087 | CAAGGATGCCGTGGATAAAATTGCTCAAGGACCTGGATGCCAATGGAGATGCCCAGGTGGACT TCAGTGAGTTCATAGTGTTCGTGGCTGCAATCACGTCTGCCTGTCACAAGTACTTTGAGAAGG CAG |
| 1074 | S100P | 2717088 | CATGGTCCCAGGCTTCCCAAAAGTGTTTGTTGGCAATTATTCCCCTAGGCTGAGCCTGCTCATG TACCTCTGATTAA |
| 1075 | CXCL1 | 2731382 | CACAGCCGCCAGACCCGCCTGCTGAGCC |
| 1076 | CXCL1 | 2731387 | AATGGGCGGAAAGCTTGCCTCAATCCTGCATCC |
| 1077 | CXCL1 | 2731388 | CTCACTGGTGGCTGTTCCTGAAGGAGGCCCTGCCCTTATAGGAACAGAAGAGGAAAGAGAG ACACAGCTGCAGAGGCCACCTGGATTGTGCCTAATGTGTTTGAGCATCGCTTA |
| 1078 | CXCL1 | 2731389 | GATTAACTCTACCTGCACACTGTCCTATTATATTCATTCTTTTTGAAATGTCAACCCCAAGTTAG TTCAATCTGGATTCATATTTAATTTGAAGGTAGAATGTTTTCAAATGTTCTCCAGTCATTATGTT AATATTTCTGAGGAGCCTGCAACATGCCAGCCACTGTGATAGAGGCTGGCGGATCCAAGCAA ATGGCCAATGAGATCATTGTGAAGGCAGGGGAATGTATGTGCACATCTGTTTTGTAACTGTTT AGATGAATGTCAGTTGTTATTTATTGAAATGATTTCACAGTGTGTGGTCAACATTTCTCATGTT GAAACTTTAAGAACTAAAATGTTCTAAATATCCCTTGGACATTTTATGTCTTTCTTGTAAGGCA TACTGCCTTGTTTAATGGTAGTTTTACAGTGTTTCTGGCTTAGAACAAAGGGGC |
| 1079 | PTPN13 | 2734630 | GAGGGTGACACACCATGCTCACGGCCCCTGGAGACCGTCGTGCTGGCGAGCCGTGCTCCGTA GCTCCCCGGTCCGCCTCGGCAGCGGTCAGAGTCGCCTACAGGAGTTGAGCGCCCGCGCCAG AAGGTTTTGGCGAAGCTCTTGGAGAGGCGTCGAGCACAGTAGGGCGGCGGGGGTGCGTTGA GCGCTCGGGGGTCAGGCAGTCGGCCGGAGATCGCCGCTGGGGAGCGTTTCCGAGGCGAGGA GGAGGAGGAGGAGATGCTGCTCCTCTTCTCCCCCCTCCCCAGGCTCCTTCTACAGCTCCTTCAG CCCACGCCCGCAGCCGCTTGTGGGAGAAGTGGTGGTGGCTCTCGGCGCCCGCGGCGGCTGC CGGCGGCCCGCCCCGACGCCGCGTCCCTGCAGCCCTCGCCCGGCGCTCCAGTAGCAGGACCC GGTCT |
| 1080 | PTPN13 | 2734634 | ATGCACGTGTCACTAGCTGAGGCCCTGGAGGTTCGGGGTGGACCACTTCAGGAGGAAGAAA TATGGGCTGTATTAAATCAAAGTGCTGAAAGTCTCCAAGAATTATTCA |
| 1081 | PTPN13 | 2734644 | TGCTGTTGCTGCCATCTGGTAGTGTGTCA |
| 1082 | PTPN13 | 2734645 | TTCCAATCAGGATCTTCGAGCATTCACTGCACCAGAGGTTCTTCAAAATCAGTCACTAACTTCT CTCTCA |
| 1083 | PTPN13 | 2734650 | GGAGATCATCTCAACAGCATACTGCTTGGAATGTGTGAGGATGTTATTTACGCTCGAGTTTCT GTTCGGACTGTGCTGGATGCTTGCAGTGCCCACATTAGGAATAGCAATTGTGCACCC |
| 1084 | PTPN13 | 2734651 | AAACTGGTTCTGGGAAATCTTTCTG |
| 1085 | PTPN13 | 2734652 | TGCTACCAGTGTATCCAGGGAATCCATGCTTGTATCCCTGCCAGATTTCCCCAAGACCTGGAC TCTTCTAGTTTTTCTCTTGTTTTGGATATGAAGAATCCCAAGAATAACCAATGCTATATATTACC TGAAAGTCCCACCTCTGTTCTGCATTTCTAAGGCTGTATTTTATCTTGTTTGCCCTATCTGATCT GGATCTATACTTTATCTGCTCTTATCCTTAGGGTTGTAGTCCTGGAGTGTTGGTCCCTCTTCCTT GCACAGGTTACAAATTTACCACTGCCACACAGTGTTCTTGTTGACTTCCTCAGAATTCCTCATC GGTAGGGGTTTAGTTCCCATCTTAACCAGGATGTCAGATGGCTGCCAGGAATGTATTCAAATT CTGCACAGTTTTTCAGTTGATAACAAACAGGCCCACAGATCTTCTAGACAAATG |
| 1086 | PTPN13 | 2734655 | CAGATCAGCTTTCCTGTAACAGTGAACAAAAGCCTGATCGAAGCCAGGCTATTCGAGATCGAT TGCGAGGAAAAGGATTACCA |
| 1087 | PTPN13 | 2734657 | AAGCTCTACTTCTGATGTACTAGACATACAAAAGCCTCCACTCTCTCATCAGACCTTTCTTAAC AAAG |

TABLE 13-continued

Subtyping Target Sequences

| SEQ ID NO. | Gene | Affy Probeset ID | Sequence |
|---|---|---|---|
| 1088 | PTPN13 | 2734658 | GCTTCATCCATGGACTTGCTTTGTACAGCTGACAGAGACTTCTCTTCAGGAGAGACTGCCACA TATCGTCGTTGTCACCCTGAGGCAGTAACAGTGCGGACTTCAACTACTCCTAGAAAAAAGGA GGCAAGATACTCAGATGGAAGTATAGCCTTGGATATCTTTGGCCCTCAGAAAATGGATCCAAT ATATCACACTCGAGAATTGCCCACCTCCTCAGCAATATCAAGTGCTTTGGACCGAATCCGAGA |
| 1089 | PTPN13 | 2734665 | TGAATCCAGCAGTGGTCTCCCAGGGGTAGATGAAACCTTAAGTCAAGGCCAGTC |
| 1090 | PTPN13 | 2734667 | GCCAAAATGGCCCTTAGACAGTCTCGGTTGAGCCTATATCCAGGAGACACAATCAAAGCGTCC ATGCTTGACATCACCAGGGATCCGTTAAGAGAAATTGCCCTA |
| 1091 | PTPN13 | 2734669 | GGAAGAATGAGGATAACCGAAGGAAAGTAAACATAATGCTTCTGAACGGGCAAAGACTGGA ACTGACCTGTGATACCAAAACTATATGTAAAGATGTGTTTGATATGGTTGTGGCACATATTGG CTTAGTAGAGCATC |
| 1092 | PTPN13 | 2734672 | GTTCATGGTGTGTCTTACTTTAGAATGGAGCACTATTTGCCCGCCAGA |
| 1093 | PTPN13 | 2734673 | GAAACTTGATTTATCCTATATCAAAGAAGAGTTACCCAAATTGCATAATACCTATGTGGGAGC TTCTGAAAA |
| 1094 | PTPN13 | 2734676 | ACCGAGTGCACCCTGAGAAGAAGTCACAAACAGGAATATTGCTTGGAGTCTGTTCTAAAGGT GTCCTTGTGTTTGAAGTTCACAATGGAGTGCGCACATTGGTCCTTCGCTTTCCATGGAGGGA |
| 1095 | PTPN13 | 2734677 | ACATTGCAAAATACATCAGATGGAATAAAACATGGCTTCCAGACAGACAACAGTAAGATATG CCAGTACCTGCTGCACC |
| 1096 | PTPN13 | 2734678 | CATAAGTTCCAGCTACAGATGAGAGCAAGACAGAGCAACCAAGATGCC |
| 1097 | PTPN13 | 2734679 | AGAGCTTCGTTTAGGAGCCTGAATCTCCAAGCAGAGTCTGTTAGAGGATTTAATATGGGACG AGCAATCAGCACTGGCAGTCTGGCCAGCAGCACCCTCAACAAACTTGCTGTTCGACCTTTATC AGTTCAAGCTGAGATTCTGAAGAGGCTATCCTGCTCAGAGCTGTCGCTTTACCAGCCATTGCA AAACAGTTCAAAAGAGAAGAATGACAAAGCTTCATGGGAGGAAAAGCCTAGAGAGATGAGT AAATCATACCATGATCTCAGTCAGGCCTCTCTCTATCCACATCGGAAAAATGTCATTGTTAACA TGGAACCCCACCACAAACCGTTCAGAGTTGG |
| 1098 | PTPN13 | 2734680 | GTTGCGAGTTTAAATAGAAGTCCTGAAAGGAGGAAACATGAATCAGACTCCTCATCCATTGA AGACCCTGGGCAAGCATATGTTC |
| 1099 | PTPN13 | 2734681 | GAATGACTATGCATAGTTCTGGAAACTCT |
| 1100 | PTPN13 | 2734684 | TCTTCACCAGAAAGGGAGATCACCTTAGT |
| 1101 | PTPN13 | 2734685 | GATTTCAAATTATTGGTGGGGAGAAG |
| 1102 | PTPN13 | 2734686 | TATTTATCAGTTCAGTTGCCCCTGGAGGACCAGCTGACTTGGATGGATGC |
| 1103 | PTPN13 | 2734687 | GCCACCATGCTGCAATTGAAATTTTGCAAAATGCACCTGAAGATGTGACACTTGTTATCTCTCA GCCAAAA |
| 1104 | PTPN13 | 2734689 | TCTTCCTACATGCAAGACAGTGCTATAGATTCTTCTTCCAAGGATCACCACTGGTCACGTGGTA CCCTGAGGCACATCTCGGAGAACTCCTTTGG |
| 1105 | PTPN13 | 2734690 | TGCCAGCCATTTAGGTGACCAAACCTGGCAGGAATCACAGCATGGCAGCCCTTCCCCATCTGT AATATCCAAAGCCACCGAGAAAGAGACTTTCACTGATAGTAACCAA |
| 1106 | PTPN13 | 2734693 | TCCTCTTCAGTGAATACATCCAACAAG |
| 1107 | PTPN13 | 2734694 | AACTTTTTCTTCATCACCTCCTAAG |
| 1108 | PTPN13 | 2734695 | CCTGGAGATATCTTTGAGGTTGAACTGGCTAAAAATGATAACAGCTTGGGGATAAGTGTCACG |
| 1109 | PTPN13 | 2734697 | GGAGGTGTGAATACGAGTGTCAGACATGGTGGCATTTATGTGAAAGCTGTTATTCCCCAGGG AGCAGCAGAGTCTGATGGTAGAATTCAC |
| 1110 | PTPN13 | 2734699 | GTGATCGCGTCCTAGCTGTCAATGGAGTTAGTCTAGAAGGAGCCACCCATAAGCAAGCTGTG GAAACACTGAGAAATACAGGA |
| 1111 | PTPN13 | 2734701 | CTGTTATTAGAAAAGGGACAATCTCCAACATCTAAAGAACATGTCCCGGTAAC |
| 1112 | PTPN13 | 2734702 | TGTACCCTTTCAGATCAGAATGCCC |
| 1113 | PTPN13 | 2734704 | GGATTCAGTTTTTCTCGAGAAGATAATCTTATACCGGAGCAAATTAATGCCAGCATAGTAAGG GTTAAAAAGC |

TABLE 13-continued

Subtyping Target Sequences

| SEQ ID NO. | Gene | Affy Probeset ID | Sequence |
|---|---|---|---|
| 1114 | PTPN13 | 2734707 | TTCAGTCTCCAGCACAAGTACTTCCAAACAGCAGTAAAGACTCTTCTCAGCCATCATGTGTGG AGCAAAGCACC |
| 1115 | PTPN13 | 2734708 | GCAAAAAACAGTGCAAGTCCCCATCCAGAAGAGACAGTTAC |
| 1116 | PTPN13 | 2734709 | GTGACAGCTCCAGCAAACATATCAAATTCGACCTGGAGTTCAGCTTTGCATCAGACTCTAAGC AACATGGTATCACAGGCACAGAGTCATCATGAAGCACCCAAGAGTCAAGAAGATACCATTTG TACCATGTTT |
| 1117 | PTPN13 | 2734710 | TTCCCCTCTACCACCGGATATGGCTCCTGGGCAG |
| 1118 | PTPN13 | 2734711 | ATCAGAATCTGCTTCCTCTAGTTCGATGGATAAGTATCATATACATCACATTTCTGAACCAACT AGACAAGAAA |
| 1119 | PTPN13 | 2734712 | CTCCTCATTACCCTAATTAAATCAGAAAAGGAAGCCTGGGTTTTACAGTAACCAAAGGCAAT CAGAGAATTGGTTGTTATGTTCATGATGTCATACAGGATCCAGCC |
| 1120 | PTPN13 | 2734713 | GATACAGATGTTACTAATATGACTCATACAGATGCAGTTAATCTGCTCCGGGCTGCATCCAAA ACAGTCAGATTAGTTATTGGACGAGTTCTAGAATTACCCAGAATACCAATGTTGCCTCATTTGC TACCGGACATA |
| 1121 | PTPN13 | 2734715 | TCCTTATGTGGAGGTCATGACAGCCTTTATCAAGTGGTATATA |
| 1122 | PTPN13 | 2734716 | AATCCAAGGTCCGTCGCAGCCATTGAGGGTAATCTCCAGCTATTAGATGTCATCCATTATGTG AACGGAGTCAGCACACAAGGAATGACCTTGGAGGAAGTTAACAGAGCATTAGACATGTCACT TCCTTC |
| 1123 | PTPN13 | 2734720 | AAGAGGTCTGCTGTTTCAGCTCCAAAGTCAACCAAAGGCAAT |
| 1124 | PTPN13 | 2734721 | GTTCCTACAGTGTGGGGTCTTGCAGCCAGCCTGCC |
| 1125 | PTPN13 | 2734723 | ATAAATGAAATATCGTACCCCAAAGGAAAATGTTCTACTTATCAGATAAAGGGATCACCAAAC TTGACTCTGC |
| 1126 | PTPN13 | 2734725 | CAAGAAGCTGAAGTTATCCAGTCTCTGCTGGATGTTGTGGATGAGGAAGCCCAGAATCTTTTA AACGAAAATAATG |
| 1127 | PTPN13 | 2734726 | AAGATGAATGGAAGTTATCAGAAGAGAGAACA |
| 1128 | PTPN13 | 2734727 | AAGATACAGACTGCGATGGTTCACCTTTACC |
| 1129 | PTPN13 | 2734730 | TGGCTGTGAAGAATATTGTGAAGAAAAAGTAA |
| 1130 | PTPN13 | 2734731 | ATGATGATGAAATAACATGGGGAAATGATGAGTTGCCAATAGAGAGAACAAACCATGAAGA TTCTG |
| 1131 | PTPN13 | 2734737 | CCTTTCTGACAAACGATGAGCTCGCTGTACTCCCTGTCGTCAAAGTGCTTCCCTCTGGTAAATA CACGGGTGCCAACTTAAAATCAGTCATTCGAGTCCTGCGGGGTTTGCTAGATCAA |
| 1132 | PTPN13 | 2734739 | AATTAAAACCTTTGGATCAGTGTCTAATTGGGCAAACTAAGGAA |
| 1133 | PTPN13 | 2734741 | GAGTTCGTTTACATTGCCTGCCAAGGACCACTGCCTACAACTGTTGGAGACTTCTGGCAGATG ATTTGGGAGCAAAAATCCACAGTGATAGCCATGATGACTCAAGAAGTAGAAGGAGAAAAA TCAAATGCCAGCGCTATTGGCCCAACATCCTAGGCAAAACAACAATGGTCAGCAACAGACTTC GACTGGCTCTTGTGAGAATGCA |
| 1134 | PTPN13 | 2734743 | TGGCCAGACCATGATACACCTTCTCAACCAGATGATCTGCTTACTTTTATCTCCTACATGAGAC ACATCCACAGATCAGGCCCAATCATTACGCACTGCAGTGCTGGCATTGGACGTTCAGGGACCC TGATTTGCATAGATGTGGTTCTGGGATTAATCAGTCAGGATCTTG |
| 1135 | PTPN13 | 2734744 | CATCTCTGATTTGGTGCGCTGCATGAGACTACAAAGACACGGAATGGTTCAGACAGA |
| 1136 | PTPN13 | 2734748 | TATATTTTCTGCTATCAAGTCATCCTTTATGTCCTGACACGTCTTCAAGCAGAAGA |
| 1137 | PTPN13 | 2734749 | CTTAGGGATGATTAAAGGCAGCATTTGATGATAGCAGACATTGTTACAAGGACATGGTGAGT CTATTTTTAATGCACCAATCTTGTTTATAGCAAAAATGTTTTCCAATATTTTAATAAAGTAGTTA TTTTATAGGGGATACTTGAAACAGTATTTAAGCTTTAAATGACAGTAATATTGGCATAGAAA AAAGTAGCAAATGTTTACTGTATCAATTTCTAATGTTTACTATATAGAATTTCCTGTAATATATT TATACTTTTTCATGAAAATGGAGTTATCAGTTATCTGTTTGTTACTGCATCATCTGTTTGTAA TCATTA |
| 1138 | SPP1 | 2735055 | TAAATTCTGGGAGGGCTTGGTTGTCAGCAGCAGCAGGAGGAGGCAGAGCACAGCATCGTCG GGACCAGACTCGTCTCAGGCCAGTTGCAGCCTTCTCAGCCAAA |

TABLE 13-continued

Subtyping Target Sequences

| SEQ ID NO. | Gene | Affy Probeset ID | Sequence |
|---|---|---|---|
| 1139 | SPP1 | 2735057 | TGAGAATTGCAGTGATTTGCTTTTGCCTCCTA |
| 1140 | SPP1 | 2735058 | GTTAAACAGGCTGATTCTGGAAGTT |
| 1141 | SPP1 | 2735059 | CCACAACAGATGAAACTGTGCCAGCCAAACAACAAATGGGCATTGTCCCCAGAAGCTTGGAC AAAAAGGCACACAGAGTTCAATTCCAGTTGAACAGAATAAAGGCCAAAATAGAGCTGCCTTG GGGGTCACTGCAATTAGACTGCTTA |
| 1142 | SPP1 | 2735062 | CATCTCAGAAGCAGAATCTCCTAGCCCCACAG |
| 1143 | SPP1 | 2735063 | AACTTCTCATAATTAAACTACAGTGATGAAAG |
| 1144 | SPP1 | 2735064 | AATGCTGTGTCCTCTGAAGAAACCAATGACTTTAAACAAGAG |
| 1145 | SPP1 | 2735066 | TTCCAAGTAAGTCCAACGAAAGCCATGACCACATGGA |
| 1146 | SPP1 | 2735067 | GACTCCATTGACTCGAACGACTCTGATGATGTAGATGACACTG |
| 1147 | SPP1 | 2735068 | CTCACCAGTCTGATGAGTCTCACCATTCTGATGAATCTGATGAACTGGTCACTGATTTTCCCAC GGACCTGCCAGCAACCGAAGTTTTCACTCCAGTTGTCCCCACAGTAGACACATATGATGGCCG AGGTGATAGTGTGGTTTATGGACTGAGGTCAAAATCTAAGAAGTTTCGCAGACCTGACA |
| 1148 | SPP1 | 2735070 | TGAATGGTGCATACAAGGCCATCCCCGTTGCCCAGGACCTGAACGCGCCTTCTGATTGGGAC AGCCGTGGGAAGGACAGTTATGAAACGAGTCAGCTGGATGACCAGAGTGCTGAAACCCACA GCCACAAGCAGTCCAGATTATATAAGCGGAAAGCCAATGATGAGAGCAATGAGCATTCCGAT GTGATTGATAGTCAGGAACTTTCCAAAGTCAGCCGTGAATTCCACAGCCATGAATTTCACAGC CATGAAGATATGCTGGTTGTAGACC |
| 1149 | SPP1 | 2735071 | TCTCACTTTGCATTTAGTCAAAAGAAAAAATGCTTTATAGCAAAATGAAAGAGAACATGAAAT GCTTCTTTCTCAGTTTATTGGTTGAATGTGTATCTATTTGAGTCTGGAAATAACTAATGTGTTT GATAATTAGTTTAGTTTGTGGCTTCATGGAAACTCCCTGTAAACTAAAAGCTTCAGGGTTATGT CTATGTTCA |
| 1150 | SPP1 | 2735072 | TTTGGTGGTGTCAATTGCTTATTTGTTTTCCCACGGTTGTCCAGCAATTAATAAAA |
| 1151 | EPCAM | 2753287 | TTAAAGGTGAATCCTTGTTTCATTC |
| 1152 | EPCAM | 2753288 | ATCTGGATCCTGGTCAAACTTTAATTTA |
| 1153 | FGFBP1 | 2761830 | ATGTCATGTCGTAAGTCCCTCTGTATACTTTAAAGCTCTCTACAGTCCCCCCAAAATATGAACT TTTGTGCTTAGTGAGTGCAACGAAATATTTAAACAAGTTTTGTATTTTTGCTTTTGTGTTTTGG AATTTGCCTTATTTTTCTTGGATGCGATGTTCAGAGGCTGTTTCCTGCAGCATGTATTTCCATG GCCCACACA |
| 1154 | FGFBP1 | 2761831 | TGAGTGCACTCAATTGGACCATGAATTTTCCTGTGTCTTTGCTGGCAATCCAACCTCATGCCTA AGCTCAAGGATGAGAGAGTCTATTGGAAACAAGTTGCCCGGAATCTGCGCTCACAGAAAGA CATCTGTAGATATTCCAAGACAGCTGTGAAACCAGAGTGTGCAGAAAGGATTTTCCAGAATC CAGTCTTAAGCTAGTCAGCTCCACTCTATTTGGGAACACAAAGCCCAGGAAGGAGAAAACAG AGATGTCCCCCAGGGAGCACATCAAAGGCAAAGAGACCACCCCCTCTAGCCTAGCAGTGACC CAGACCATGGCCACCAAAGCTCCCGAGTGTGTGGAGGACCCAGATATGGCAAACAGAGGA AGACTGCCCTGGAGTTCTGTGGAGAGACTTGGAGCTCTCTGCACATTCTTCCTCAGCATAG TGCAGGACACGTC |
| 1155 | FGFBP1 | 2761832 | ATGAAGATCTGTAGCCTCACCCTGCTCTCCTTCCTCCTACTGGCTGCTCAGGTGCTCCTGGTGG AGGGGAAAAAAAAAGTGAAGAATGGACTTCACAGCAAAGTGGTCTCAGAA |
| 1156 | FGFBP1 | 2761833 | GAGGAGCTGTGAGTAACGTGCCACAGTGTTGTAAAAACCCAGTGAGTGTTATAAAAACCCAG TCAGCCTGGCTCCTGTTGAATAGTCTACCCCCCTTGCACTCTACCTGACACAGCTGCAGCCTGC AATTCACTCGCACTGCCTGGGATTGCACTGGATCCG |
| 1157 | FGFBP1 | 2761834 | AGAGCGGATGTGATGAGGGAAAAGGAGAACTCAG |
| 1158 | CXCL9 | 2773948 | TCTCTTGAATGTACCCTTCAACTGTTGAATGTTTAATAGTAAATCTTATATGTCCTTATTTACTTT TTAGCTTTCTCTCAAATAAAGTGTAACACTAGTTGAGATAA |
| 1159 | CXCL9 | 2773949 | AGCCCTAGGCTTCCACGTACTGCAGCCTCCAGAGAGTATCTGAGGCACATGTCAGCAAGTCCT AAGCCTGTTAGCATGCTGGTGAGCCAAGCAGTTTGAAATTGAGCTGGACCTCACCAAGCTGC TGTGGCCATCAACCTCTGTATTTGAATCAGCCTACAGGCCTCACACACAATGTGTCTGAGAGA TTCATGCTGATTGTTATTGGGTATCACCACTGCAGAGCCTCC TTTCTGGCTTTGGAAGCCATGTGATTCCATCTTGCCCGCTCAGGCTGACCACTTTATTTCTTTTT GTTCCCCTTTGCTTCATTCAAGTCAGCTCTTCTCCATCCTACCACAATGCAGTGCCTTTCTTCTCT CCAGTGCACCTGTCATATGCTCTGATTTATCTGAGTCAACTCCTTTCTCATCTTGTCCCCAACAC CCCACAGAAGTGCTTTCTTCTCCCAATTCATCCTCACTCAGTCCAGCTTAGTTCAAGTCCTGCCT CTTAAATAAACCTTTTTGGACACACAAATTATCTTAAAACTCCTGTTTCACTTGGTTCAGTACCA |

TABLE 13-continued

Subtyping Target Sequences

| SEQ ID NO. | Gene | Affy Probeset ID | Sequence |
|---|---|---|---|
| | | | CATGGGTGAACACTCAATGGTTAACTAATTCTTGGGTGTTTATCCTATCTCTCCAACCAGATTG<br>TCAGCTCCTTGAGGGCAAGAGCCACAGTATATTTCCCTGTTTCTTCCACAGTGCCTAATAATAC<br>TGTGGAACTAGGTTTTAATAATTTTTTAATTGATGTTGTTATGGGCAGGATGGCAACCAGACC<br>ATTGTCTCAGAGCAGGTGCTGGCTCTTTCCTGGCTACTCCATGTTGGCTAGCCTCTGGTAACCT<br>CTTACTTATTATCTTCAGGACACTCACTACAGGGACCAGGGATGATGCAACATCCTTGTCTTTT<br>TATGACAGGATGTTTGCTCAGCTTCTCCAACAATAAGAAGCACGTGGTAAAACACTTGCGGAT<br>ATTCTGGACTGTTTTTAAAAAATATACAGTTTACCGAAAATCATATAATCTTACAATGAAAAGG<br>ACTTTATAGATCAGCCAGTGACCAACCTTTTCCCAACCATACAAAAATTCCTTTTCCCGAAGGA<br>AAAGGGCTTTCTCAATAAGCCTCAGCTTTCTAAGATCTAACAAGATAGCCACCGAGATCCTTA<br>TCGAAACTCATTTTAGGCAAATATGAGTTTTATTGTCCGTTTACTTGTTTCAGAGTTTGTATTGT<br>GATTATCAATTACCACACCATCTCCCATGAAGAAAGGGAACGGTGAAGTACTAAGCGCTAGA<br>GGAAGCAGCCAAGTCGGTTAGTGGAAGCATGATTGGTGCCCAGTTAGCCTCTGCAGGATGTG<br>GAAACCTCCTTCCAGGGGAGGTTCAGTGAATTGTGTAGGAGAGGTTGTCTGTGGCCAGAATT<br>TAAACCTATACTCACTTTCCCAAATTGAATCACTGCTCACACTGCTGATGATTTAGAGTGCTGT<br>CCGGTGGAGATCCCACCCGAACGTCTTATCTAATCATGAAACTCCCTAGTTCCTTCATGTAACT<br>TCCCTGAAAAATCTAAGTGTTTCATAAATTTGAGAGTCTGTGACCCACTTACCTTG |
| 1160 | CXCL9 | 2773950 | AAGTTCTGAAAGTTCGAAAATCTCAACGTTCTCGTCAAAAGAAGACTACATA |
| 1161 | CXCL9 | 2773951 | CTGAAGAATGGAGTTCAAACATGTCTAAACCCAGATTCAGCAGATGTGA |
| 1162 | CXCL9 | 2773952 | AGAAAGGGTCGCTGTTCCTGCATCAGCACCAACCAAGGGACTATCCACCTACAATCCTTGAAA<br>GACCTTAAACAATTTGCCCCAAGCCCTTCCTGCGAGAAAATTG |
| 1163 | CXCL9 | 2773953 | CCTCTTGGGCATCATCTTGCTGGTTCTGATTGGAGTGCAAG |
| 1164 | CXCL10 | 2773961 | TTCCAAGGATGGACCACACAGAGGCTGCCTCTCCCATCACTTCCCTACATGGAGTATATGTCA<br>AGCCATAATTGTTCTTAGTTTGCAGTTACACTAAAAGGTGACCAATGATGGTCACCAAATCAG<br>CTGCTACTACTCCTGTAGGAAGGTTAATGTTCATCATCCTAAGCTATTCAGTAATAACTCTACC<br>CTGGCACTATAATGTAAGCTCTACTGAGGTGCTATGTTCTTAGTGGATGTTCTGACCCTGCTTC<br>AAATATTTCCCTCACCTTTCCCATCTTCCAAGGGTACTAAGGAATCTTTCTGCTTTGGGGTTTAT<br>CAGAATTCTCAGAATCTCAAATAACTAAAAGGTATGCAATCAAATCTGCTTTTTAAAGAATGCT<br>CTTTACTTCATGGACTTCCACTGCCATCCTCCCAAGGGGCCCAAATTCTTTCAGTGGCTACCTA<br>CATACAATTCC |
| 1165 | CXCL10 | 2773963 | AAGAGATGTCTGAATCCAGAATCGAAGGCCATCAAGAATTTACTGAAAGCAGTTAGCAAGGAA |
| 1166 | CXCL10 | 2773966 | AACTTGAAATTATTCCTGCAAGCCAATTTTGTCCACGTGTTGAG |
| 1167 | CXCL10 | 2773967 | TACCTGCATCAGCATTAGTAATCAACCTGTTAATCCAAGGTCTTTAG |
| 1168 | CXCL10 | 2773970 | TGCCATTCTGATTTGCTGCCTTATCTTTCTGACTCTAAGTGGCATTCAAG |
| 1169 | CXCL10 | 2773971 | ATTGCTTAGACATATTCTGAGCCTACAGCAGAGGAACCTCCAGTCTCAGCAC |
| 1170 | SPARCL1 | 2777118 | CAGCTGTGATACTTGTAGATTTATATTTAGCAAAATGTTAGCATGTATGACAAGACAATGAGA<br>GTAATTGCTTGACAACAACCTATGCACCAGGTATTTAACATTAACTTTGGAAACAAAAATGTA<br>CAATTAAGTAAAGTCAACATATGCAAAATACTGTACATTGTGAACAGAAGTTTAATTCATAGT<br>AATTTCACTCTCTGCATTGACTTATGAGATAATTAATGATTAAACTATTAATGATAAAAATAAT<br>GCATTTGTATTGTTCATAATATCATGTGCACTTCAAGAAAATGGAATGCTACTCTTTTGTGGTT<br>TACGTGTA |
| 1171 | SPARCL1 | 2777124 | TGCTCCTCTGCGAGCATCTCTGGTGCCCATGGAACACTGCATAACCCGTTTCTTTGAGGAGTG<br>TGACCCCAACAAGGATAAGCACATC |
| 1172 | SPARCL1 | 2777125 | TGATCTTCTCTTAAGGGACTTTAAGAAAAACTACCACATGTATGTGTATCCTGTGCACTGGCA<br>GTTTAGTGAACTTGACCAACACCCTATGGATA |
| 1173 | SPARCL1 | 2777126 | CCTACTTGTACGGACTTTGAAGTGATTCAGTTTCCTCTACGGATGAGAGACTGGCTCAAGAAT<br>ATCCTCATGCAGCTTTATGAAGCCAACTCTGAACACGCTGGTTATCTAAATGAGA |
| 1174 | SPARCL1 | 2777131 | TGTGGCACTGACAATCAGACCTATGCTAGTTCCTGTCATCTATTCGCTACTAAATGCAGACTGG<br>AGGGGACCAAAAAGGGGCATCAACTCCAGCTGGATTATTTTGGAGCCTGCA |
| 1175 | SPARCL1 | 2777132 | TCTTGCATGAGCTTCCAGTGTAAAAGAGGCCACATCTGTAAGGCAGACCAACAGGGAAACC<br>TCACTGTGTCTGCCAGGATCCAGTGACTTGTCCTCCAACA |
| 1176 | SPARCL1 | 2777133 | AGCAGAGAACTCATCAAATGAGGAGGAAACGTCAAGTGAAGGCAACATGAGGGTGCATGCT |
| 1177 | SPARCL1 | 2777136 | CCACGCCCAGAAATCATGGAGTTGATGATGATGGCGATGATGATGGCGATGATGGCGGCACT<br>GATGGCCCCAGGCACAGTGCAAGTGATGACTACTTCATCCCAAGCCAGGCCTTTCTGGAGGC<br>CGAGAGAGCTCAATCCATTGC |

TABLE 13-continued

Subtyping Target Sequences

| SEQ ID NO. | Gene | Affy Probeset ID | Sequence |
|---|---|---|---|
| 1178 | SPARCL1 | 2777137 | GAAGCTATCAGCAACCACAAAGAGACAGAAGAAAAGACTGTTTCTGAGGCTCTGCTCATGGA ACCTACTGATGATG |
| 1179 | SPARCL1 | 2777138 | TAGCCAAGGCCTAAGGGATCAAGGAAACCAAGAGCAGGATCCAAATATTTCCAATGGAGAA GAGGAAGAAGAAAAAGAGCCAGGTGAAGTTGGTACCCACAATGATAACCAAGAAAGAAAG ACAGAATTGCCCAGGGAGCATGCTAACAGCAAGCAGGAGGAAGACAATACCCAATCTGATG ATATTTTGGAAGAGTCTGATCAACCAACTCAAGTAAGCAAGATGCAGGAGGATGAATTTGAT CAGGGTAACCAAGAACAAGAAGATAACTCCAATGCAGAAATGGAAGAGGAAAATGCATCGA ACGTCAATAAGCACATTC |
| 1180 | SPARCL1 | 2777139 | TGGAGTATGCACCAACTGAAGGTACATTGGACATAAAAGAAGATATGAGTGAGCCTCAGGA GAAAAAACTCTCAGAGAACACTGATTTTTTGGCTCCTGGTGTTAGTTCCTTC |
| 1181 | SPARCL1 | 2777140 | TCATCAGTACTAAAGTCAAAAGAGGAAAGCCATGAACAGTCAGCAGAACAGGGCAAGAGTT CTAGCCAAGAGCTGGGATTGAAGGATCAAGAGGACAGTGATGGTCACTTAA |
| 1182 | SPARCL1 | 2777141 | CAGTATCCACAGAAGACGATTCCCACCATAAG |
| 1183 | SPARCL1 | 2777142 | CAACTGCTGAAACGGTAGCACCTGACAACACTGCAATCCCCAGTTTAAGGGCTG |
| 1184 | SPARCL1 | 2777143 | CAAGATTATTATCTGATCATTCCAAAC |
| 1185 | SPARCL1 | 2777144 | CCTATGTCTCTTGGGAACTGCAGCTG |
| 1186 | SPARCL1 | 2777159 | TGGCTCTGGGTCCAGCCCCTTACTTAA |
| 1187 | SPARCL1 | 2777160 | TTCCCTTTTGGTTTGCAAGCACTGCCTGTAAAGCCCTCGCATGAGAGGCCAGCCTGCTAGGGA AATCCAGGAATCTGCAACAAAAACGATGACAGTCTGAAATACTCTCTGGTGCCA |
| 1188 | SFRP2 | 2790370 | ATTGACTTGAGTACTTTAAGCCTTGTT |
| 1189 | SFRP2 | 2790371 | TAGGTGCAACTGTGACTTGGGTCTGGTTGGTTGTTGTTTGTTGTTTTGAGTCAGCTGATTTTCA CTTCCCACTGAGGTTGTCATAACATGCAAATTGCTTCAATTTTCTCTGTGGCCCAAACTTGTGG GTCACAAACCCTGTTGAGATAAAGCTGGCTGTTATCTCAACATCTTC |
| 1190 | SFRP2 | 2790372 | GCTGACCATTTCTGCTCCGGGATCTCAGCTCCCGTTCCCAAGCACACTCCTAGCTGCTCCAGT CTCAGCCTGGGCAGCTTCCCCCTGCCTTTTGCACGTTTGCATCCCCAGCATTTCCTGAGTTATA AGGCCACAGGAGTGGATAGCTGTTTTCACCTAAAGGAAAAGCCCACCCGAATCTTGTAGAAA TA |
| 1191 | SFRP2 | 2790373 | TGATCACCTCGGTGAAGCGGTGGCAGAAGGGGCAGAGAGAGTTCAAGCGCATCTCCCGCAG CATCCGCAAGCTGCAGTGCTA |
| 1192 | SFRP2 | 2790374 | AGGAGATAACCTACATCAACCGAGATACCAAAATCATCCTGGAGACCAAGAGCAAGACCATT TACAAGCTGAACGGTGTGTCCGAAAGGGACCTGAAGAAATCGGTGCTGTGGCTCAAAGACA GCTTGCAGTGCACCTGTGAGGAGATGAACGACATCAACGCGCCCTATCTGGTCATGGGACA |
| 1193 | SFRP2 | 2790378 | TGATGACAACGACATAATGGAAACGCTTTGTAAA |
| 1194 | SFRP2 | 2790379 | CTGTGCCACGGCATCGAATACCAGAACATGCGGCTGCCCAACCTGCTGGGCCACGAGACCAT GAAGGAGGTGCTGGAGCAGGCCGGCGCTTGGATCCCGCTGGTCATGAAGCAGTGCCACCCG GACACCAAGAAGTTCCTGTGCTCGCTCTTCGCCCCCGTCTGCCTCGATGACCTAGACGAGACC ATCCAGCCATGCCACTCGCTCTGCGTGCAGGTGAAGGACCGCTGCGCCCCGGTCATGTCCGCC TTCGGCTTCCCCTGGCCCGACATGCTTGAGTGCGACCGTTTC |
| 1195 | SFRP2 | 2790380 | TGCTGCAGGGCCCTGGCTCGCTGCTGCTGCTCTT |
| 1196 | SFRP2 | 2790381 | AGCGGGCCCGGGACAAGCTCGAACTCCGGCCGCCTC |
| 1197 | SFRP2 | 2790382 | AGCTGCGCGCGGGCTTGCAGCGCCTCGCCCGCGCTGTCCTCCCGGTGTCCCGCTTCTCCGCGC CCCAGCCGCCGGCTGCCAGCTTTTCGGGGCCCCGAGT |
| 1198 | HPGD | 2794410 | TCTCTGGTGTATACTGATTGAGAAAATAATTAAACTGA |
| 1199 | HPGD | 2794411 | ATACACCTGCTTTGGGTAAAACTCTTTGCAAGCAGTAATTAACACTAGTAACAGTGAAAGCAC AAGATTTCCAAATCAGTCGTTTTCTCAAAAAAATATCGTATAAGTGACTCATCCTGTCTGCTAA CTCCAGACCTCCCAGCTTGAAGCCAAATCTTTCCATGTGAGATTGATATGGATTCCTAGAAGT ACTGGAATGTTGTCATATCTTGCCCTATTTTAATTCTGCTATAGAAAACAATTGCCTTCACTTTT AAGGAGTAATTTGAATATTAATAACTCTGGTCTAGATTTTCATATAATGTATTAAAGACAAAGT AGTGAACATCAATGAACATCTGATAGAGATAAACTGTAATCAGGCATAAGCTTGTTTGTATGT TCTGGCAGTGACTAATCAGTAAATGATGTCGGTTTGCCCAGTATCACTTATC |
| 1200 | HPGD | 2794412 | TTACTTAGTCTTCTATGTATAGCTATCAAGGA |

TABLE 13-continued

Subtyping Target Sequences

| SEQ ID NO. | Gene | Affy Probeset ID | Sequence |
|---|---|---|---|
| 1201 | HPGD | 2794413 | TGCACTTGGTGATAAACGTTTTCTAAATTTTTAGTTAAGTATATGGATAAAAAGTTATGAACTA<br>TTAAAAATGTGATGTGGACCAAAGGCTAGGTTGTAATCTTGATAGTCTAAAAAATGATCAAAA<br>CAAATGATTTTCAAGGAATATTCAATATTCTGCCTTTCAGAAAGTGTATTTATATCTGTGCTTCA<br>TAAATATTAATGTTCTTCAGAACATCATTTTAAAGGAGATACTTGAATTGTTATTTAAATCAAA<br>CCAGATGTAAAACACTCACATACAAGTTCATACTTTAAAAGAGGAAAGCTACTTAACAATGAC<br>AAATATTTCACAATAATAATTTTTACTTATATACCATCTTTCAACTGAACATTTCAGTTCTTCCAA<br>GAGCTTCTTAGAGTAGTATATTTTGGGGGCAGTCAAGGAATAAACTACAGTGTAAACATATCC<br>CAGATGAAAACTGCTGTATGGAAAAATGACAGAAAGTAACTGATTGACACTGTTGATTCACA<br>GTTCAGCCTCCTATCTG |
| 1202 | HPGD | 2794414 | TGCCAATGGATTGATAACACTCATTGAAGATGATGCTTTAAATGGTGCTATTATGAAGATCAC<br>AACTTCTAAGGGAATTCATTTTCAAGACTATGATACAACTCCATTTCAAG |
| 1203 | HPGD | 2794416 | TCTTATGAACAGTGGTGTGAGACTGAATGCCATTTGTCCAGGCTTTGTTAACACAGCCATCCTT<br>GAATCAATTGAAAAGAAGAAAACATGGGACAATATATAGAATATAAGGATCATATCAAGG |
| 1204 | HPGD | 2794417 | ATGCCCGTTGCACAGCAGCCGGTTTATTGTGCTTCAAAGCA |
| 1205 | HPGD | 2794423 | GACGATCTGGGAGAAATTCTTTACCATAA |
| 1206 | HPGD | 2794424 | AGCAAAGCTTGGAGTACCATGAATATTCTACAAGGAG |
| 1207 | HPGD | 2794425 | GGGCTGTGATCAAGATTGATAATTCTCTGTATTC |
| 1208 | HPGD | 2794426 | GTACCTGTGATTGAACCTCTGTCTGATTCTCAGCATTTGTCTCATCCCTCTAGGAATGATTATCA<br>AATGGTTCTTTTATATCACTGTAAAGCTGCCACCAGAGGAGATTTAGAAATCTCCTTTAGAAGT<br>TCTCAAAAATAGACTAGCATCTCATTTTCTGGGTCGCTTAAAGTCAAAATCATGTCCCTAAAGC<br>TATTACAAACCTATTTCTATAAATTTTTCAGGGTAATCAGATTCTTTTTCCTAGTGGTACAACTA<br>CTTATAAATTATAACATTTTAATCCTAATGATACTTTAAAAGGTGAGCGCACGGGCAATATTTG<br>AAAG |
| 1209 | HPGD | 2794427 | AGCTCCCAGGGTTACTTTAGAACTGCTGGATTCCTTTTTCTCTAGCAGAAAGAGAAGAAGAAC<br>ATGGAGGAGGCATGGCTACTCTTTTAAGAACCCCAGCCCAGTAATGGCAGACCTTCTGCTCAC<br>ATTTCAGTATAGAACTTGAGCTCATGTTTCACCTAACTGTAAGCGAGTCTGTCTGGGAAATGC<br>AGTCTAGCTGTGTGCCTAAGAGAAGAATGGATTTCAGAGGGCAGCTAATCATCTTTTC |
| 1210 | HPGD | 2794428 | ATCAGTGGAACCTATCTTGGTTTGGATTACATGAGTAAGCAAAATGGAGGTGAAGGCGGCAT<br>CATTATCAATATGTCATC |
| 1211 | HPGD | 2794432 | TAATGCTGGAGTGAATAATGAGAAA |
| 1212 | HPGD | 2794435 | TAGCGCTGGTGGATTGGAATCTTGAAGCAGGTGTACAGTGTAAAGCTGCCCTGGATGAGCAG<br>TTTGAACCTCAGAAGACTCTGTTCATCCAGTGCGATGTGGCTGACCAGCAACAACTGAGAG |
| 1213 | HPGD | 2794436 | TTGCCAAATTTCAGGTCCAGGAGGGGAGCCTCTTGTGTGTTTATTGTTTGTCCGTCTATTTCGT<br>GAGCTGCGCAGGCCCGCGATTCCTCTCCTCTTGTCTATA |
| 1214 | HPGD | 2794438 | ATGCACGTGAACGGCAAAGTGGCGCTGGTG |
| 1215 | HPGD | 2794439 | CTATCCAGTTGGTCTTTAGGGCACTGAAGGAAACTCTTCTTCAGAAATAACCTTTTAACTTTTC<br>TTCTGTCAGCTGCCTGCCAATCACGGAGCCAGAGGCTGAGGGGAGGCTTTGAGCCGGTCTGC<br>GAGTCCGGAAGGCAAAGATCGCGAAGCTTGGCGCTCCAGAACGCTCA |
| 1216 | VCAN | 2818523 | TCTTCTCGCTGAGTCTCCTCCTCGGCTCTGACGGTACAGTGATATAATGATGATGGGTGTCAC<br>AACCCGCATTTGAACTTGCA |
| 1217 | VCAN | 2818524 | CCGAGAACATTAGGTGTTGTGGACAGGAGCTGGGACCAAGATCTTCGGCCAGCCCCGCATCC<br>TCCCGCATCTTCCAGCACCGTCCCGCACCCTCCGCATCCTTCCCCGGGCCACCACGCTTCCTAT<br>GTGACCCGCCTGGGCAACGCCGAACCCAGTCGCGCA |
| 1218 | VCAN | 2818525 | TTCCCCCCAAACTGCAATAAGCCGCCTTCC |
| 1219 | VCAN | 2818529 | TAAAGAGCATCTTATGGATGTGTTCAACCTTAATAGTAACCCATGCGCTACATAAAG |
| 1220 | VCAN | 2818532 | TGGAAAAGTCAGCCTACCTTGTCATTTT |
| 1221 | VCAN | 2818533 | TGCCTACTTTGCCACCCAGTTACAACACCAGTGAATTTCTCCGCATCAAATGGTCTAAGATTGA<br>AGTGGACAAAAATGGAAAAGATTTGAAAGAGACTACTGTCCTTGTGGCCCAAAATGGAAATA<br>TCAAGATTGGTCAGGACTACAAAGGGAGAGTGTCTGTGCCCACACATCCCGAGGCTGTGGGC<br>GATGCCTCCCTCACTGTGGT |
| 1222 | VCAN | 2818534 | TGATGCGGGTCTTTACCGCTGTGACGTCATGTACGGGATTGAAGACACACAAG |

TABLE 13-continued

Subtyping Target Sequences

| SEQ ID NO. | Gene | Affy Probeset ID | Sequence |
|---|---|---|---|
| 1223 | VCAN | 2818535 | CAGGGCGGCAACCAGCAGGTACACACTGAATTTTGAGGCTGCTCAGAAGGCTTGTTTGGACG TTGGGGCAGTCATAGCAACTCCAGAGCA |
| 1224 | VCAN | 2818536 | ATCCCATCCGGGCTCCCAGAGTAGGCTGTTATGGAGATAAGATGGGAAAGGCAGGAGTCAG GACTTATGGATTCCGTTCTCCCCAGGAAACTTACGATGTGTATTGTTATGTGGATCATCTGGA |
| 1225 | VCAN | 2818543 | GGAACGGCTTTGACCAGTGCGATTACGGGTGGCTGTCGGATGCCAGCGTGCGCCACCCTGTG ACTGTGGCCAGGGCCCAGTGTGGAGGTGGTCTACTTGGGGTGAGAACCCTGTATCGTTTTGA GAACCAGACAGGCTTCCCTCCCCCTGATAGCAGATTTGATGCCTAC |
| 1226 | VCAN | 2818544 | CAACTAGCCGTTGGAGTGGATTCCATGTCTTGCAGTGTGTGCACGGAATGGAAACAGTTCAG TGATTTTCAAAAGCAAGCAAACTGAACAGCAGTGATATGGTTAAAACCACAGGAATTTTGGC AAATGGATTTTTAGAGGGGTGAGGAAATATCAGGTTAAGCTGTAACTGTGCTCTGTTGTGTCC AGAGCCACAGAGCATTTTTCTAAGTATTTTATATTAATTGCAGTCCTTAAGTTTTGCAATTTGTT TATTGGTGTTACAATGCCAAGGCCAACTGAGGCTGAGTTAAATCCTTA |
| 1227 | VCAN | 2818549 | CCTCCCGTGGGAAATATTGTCAGTTTTGAACAGAAAGCCACAGTCCAACCTCAGGCTATCACA GATAGTTTAGCCACCAAATTACCCACACCTACTGGCAGTACCAAGAAGCCCTGGGATATGGAT GACTACTCACCTTCTGCTTCAGGACCTCTTGGAAAGCTAGACATATCAGAAATTAAGGAAGAA GTGCTCCAGAGTACAACTGGCGTCTCATTATGCTACGGATTCATGGGATGGTGTCGTGGAA GATAAACAAACACAAGAATCGGTTACACAGATTGAACAAATAGAAGTGGGTCCTTTGGTAAC ATCTATGGAAATCTTAAAGCACATTCCTTCCAAGGAATTCCCTGTAACTGAAACACCATTGGTA ACTGCAAGAATGATCCTGGAATCCAAAACTGAAAAGAAAATGGTAAGCACTGTTTCTGAATT GGTAACCACAGGTCACTATGGATTCACCTTGGGAGAAGAGGATGATGAAGACAGAACACTTA CAGTTGGATCTGATGAGAGCACCTTGATCTTTGACCAAATTCCTGAAGTCATTACGGTGTCAA AGACTTCAGAAGACACCATCCACACTCATTTAGAAGACTTGGAGTCAGTCTCAGCATCCACAA CTGTTTCCCCTTTAATTATGCCTGATAATAATGGATCATCCATGGATGACTGGGAAGAGAGAC AAACTAGTGGTAGGATAACGGAAGAGTTTCTTGGCAAATATCTGTCTACTACACCTTTTCCATC ACAGCATCGTACAGAAATAGAATTGTTCCTTATTCTGGTGATAAAATATTAGTAGAGGGAAT TTCCACAGTTATTTATCCTTCTCTACAAACAGAAATGACACATAGAAGAGAAAGAACAGAAAC ACTAATACCAGAGATGAGAACAGATACTTATACAGATGAAATACAAGAAGAGATCACTAAAA GTCCATTTATGGGAAAAACAGAAGAAGAAGTCTTCTCTGGGATGAAACTCTCTACATCTCTCT CAGAGCCAATTCATGTTACAGAGTCTTCTGTGGAAATGACCAAGTCTTTTGATTTCCCAACATT GATAACAAAGTTAAGTGCAGAGCCAACAGAAGTAAGAGATATGGAGGAAGACTTTACAGCA ACTCCAGGTACTACAAAATATGATGAAAATATTACAACAGTGCTTTTGGCCCATGGTACTTTA AGTGTTGAAGCAGCCACTGTATCAAAATGGTCATGGGATGAAGATAATACAACATCCAAGCC TTTAGAGTCTACAGAACCTTCAGCCTCTTCAAAATTGCCCCCTGCCTTACTCACAACTGTGGGG ATGAATGGAAAGGATAAAGACATCCCAAGTTTCACTGAAGATGGAGCAGATGAATTTACTCT TATTCCAGATAGTACTCAAAAGCAGTTAGAGGAGGTTACTGATGAAGACATAGCAGCCCATG GAAAATTCAACAATTAGATTTCAGCCAACTACATCAACTGGTATTGCAGAAAAGTCAACTTTGA GAGATTCTACAACTGAAGAAAAAGTTCCACCTATCACAAGCACTGAAGGCCAAGTTTATGCAA CCATGGAAGGAAGTGCTTTGGGTGAAGTAGAAGATGTGGACCTCTCTAAGCCAGTATCTACT GTTCCCCAATTTGCACACACTTCAGAGGTGGAAGGATTAGCATTTGTTAGTTATAGTAGCACC CAAGAGCCTACTACTTATGTAGACTCTTCCCATACCATTCCTCTTTCTGTAATTCCCAAGACAGA CTGGGGAGTGTTAGTACCTTCTGTTCCATCAGAAGATGAAGTTCTAGGTGAACCCTCTCAAGA CATACTTG |
| 1228 | VCAN | 2818550 | CAGAAACCGATATTGATAGAGAGTATTTCACGACTTCAAGTCCTCCTGCTACACAGCCAACAA GACCACCCACTGTGGAAGACAAAGAGGCCTTTGGACCTCAGGCGCTTTCTACG |
| 1229 | VCAN | 2818556 | GGGTTGGCTCCGTCATAATGATTTCTCCTAAACACTTCTCAGGTTTGGCCTATGCATGTGTGTT ATAGATTGGGGATAGTTTGAAAACTCATTCTGTAGTATTATTCCTATGGGCAGGGTGGTGAGT AGTGTGTAAATTCTTTGTCTTCTTTATGGGTCAGTATATCCACAGGCACATTTTCATACTGCTTT GTCACTGAAAGTAAGGCAGCTGCAGTGGCAGGACCCTGTTCTAGGACAGTTGAATGCCTCTA TGATGAGACCTCAGA |
| 1230 | VCAN | 2818557 | AAAAGGCCATTGAGCTTAGTGGTTGGTACCATATGGCAATTTACAATCTGGGAAATATTCTGA TGATACATACTTTTCGAGGAATGCTA |
| 1231 | VCAN | 2818558 | ATCAGCCTAATCTGGGTCACATCCCAGGAAGGATAAAGGTCTATAGGTGTGGAAGGCTCTTT CTGGTCCTTTCAGTGAGCTATTTCAATAGAGCCCGCCTATCCAGAGCTTCCCACTCTTGTGCA TAGGATGTGGTTAAGCTCATGTCTCAGTGCCACAGTAGGTAGAGGATGCCATT |
| 1232 | VCAN | 2818559 | TCGAATGAGTGATTTGAGTGTAATTGGTCATCCAATAGATTCAGAATCTAAAGAAGATGAACC TTGTAGTGAAGAACAGA |
| 1233 | VCAN | 2818560 | GTGCATGATCTAATGGCTGAAATTTTACCTGAATTCCCTGACATAATTGAAATAGACCTATACC ACAGTGAAGAAAATGAAGAAGAAGAAGAAGAGTGTGCAAATGCTACTGATGTG |
| 1234 | VCAN | 2818561 | TGGGAAGCATCTCGTTACCACTGTGCCCAAGGACCCAGAAGCTGCAGAAGCTAGGCGTGGCC AGTTTGAAAGTGTTGCACCTTCTCAGAATTTCTCGGACAGCTCTGAAAGTGATACTCATCCATT TGTAATAGCCAAAACGGAATTGTCTACTGCTGTGCAACCTAATGAATCTACAGAAACAACTGA GTCTCTTGAAGTTACATGGAAGCCTGAGACTTACCCTGAAACATC |

TABLE 13-continued

Subtyping Target Sequences

| SEQ ID NO. | Gene | Affy Probeset ID | Sequence |
|---|---|---|---|
| 1235 | VCAN | 2818562 | GCTCTCAGGGAGTTCTTCGATTCCAATTACAGAAGGCTCTGGAGAAGCAGAAGAAGATGAAGATACAATGTTCACCATGGTAACTGATTTATCACAGAGAAATACTACTGATACACTCATTACTTTAGACACTAGCAGGATAATCACAGAAAGCTTTTTTGAGGTTCCTGCAACCACCATTTATCCAGTTTCTGAACAACCTTCTGCAAAAGTGGTGCCTACCAAGTTTGTAAGTGAAACAGACACTTCTGAGTGGATTTCAGTACCACTGTTGAGGAAAAGAAAAGGAAGGAGGAGGAGGGAACTACAGGTACGGCTTCTACATTTGAGGTATATTCATCTACACAGAGATCGGATCAATTAATTTTACCCTTTGAATTAGAAAGTCCAAATGTAGCTACATCTAGTGATTCAGGTACCAGGAAAAGTTTTATGTCCTTGACAACACCAACACAGTCTGAAAGGGAAATGACAGATTCTACTCCTGTCTTTACAGAAACAAATACATTAGAAAATTTGGGGGCACAGACCACTGAGCACAGCAGTATCCATCAACCTGGGGTTCAGGAAGGGCTGACCACTCTCCCACGTAGTCCTGCCTCTGTCTTTATGGAGCAGGGCTCTGGAGAAGCTGCTGCCGACCCAGAAACCACCACTGTTTCTTCATTTTCATTAAACGTAGAGTATGCAATTCAAGCCGAAAAGGAAGTAGCTGGCACTTTGTCTCCGCATGTGGAAA |
| 1236 | VCAN | 2818563 | CCCTGGGAAGAGTTTACATCCTCAGCTGAGGGCTCAG |
| 1237 | VCAN | 2818564 | TGAGCAACTGGTCACAGTCAGCAGCTCTGTTGTTCCAGTGCTTCCCAGTGCTGTGCAAAAGTTTTCTGGTACAGCTTCCTCCATTATCGACAAGGATTGGGAGAAGTGGGTACTGTCAATGAAATTGATAGAAGATCCACCATTTTACCAACAGCAGAAGTGGAAGGTACGAAAGCTCCAGTAGAGAAGGAGGAAGTAAAGGTCAGTGGCACAGTTTCAACAAACTTTCCCCAAACTATAGAGCCAGCCAAATTATGGTCTAGGCAAGAAGTCAACCCTG |
| 1238 | VCAN | 2818565 | GGTCCACAGACGGTAGTTTCCAAGACCGTTTCAGGGAATTCGAGGATTCCACCTTAAAACCTAACAGAAAAAAACCCACTGAAAATATTATCATAGACCTGGACAAAGAGGACAAGGATTTAATATTGACAATTACAGAGAGTACCATCCTTGAAATTCTACCTGAGCTGACATCGGATAAAAATACTATCATAGATATTGATCATACTAAACCTGTGTATGAAGACATTCTTGGAATGCAAACAGATATAGATACAGAGGTACCATCAGAACCACATGACAGTAATGATGAAAGTAATGATGACAGCACTCAAGTTCAAGAGATCTATGAGGCAGCTGTCAACCTTTCTTTAACTGAGGAAACATTTGAGGGCTCTGCTGATGTTCTGGCTAGCTACACTCAGGCAACACATGATGAATCAATGACTTATGAAGATAGAAGCCAACTAGATCACATGGGCTTTCACTTCACAACTGGGATCCCTGCTCCTAGCACAGAAACAGAATTAGACGTTTTACTTCCCACGGCAACATCCCTGCCAATTCCTCGTAAGTCTGCCACAGTTATTCCAGAGATTGAAGGAATAAAAGCTGAAGCAAAAGCCCTGGATGACATGTTTGAATCAAGCACTTTGTCTGATGGTCAAGCTATTGCAGACCAAAGTGAAATAATACCAACATTGGGCAATTTGAAAGGACTCAGGAGGAGTATGAAGACAAAAAACATGCTGGTCCTTCTTTTCAGCCAGAATTCTCTTCAGGAGCTGAGGAGGCATTAGTAGACCATACTCCCTATCTAAGTATTGCTACTACCCACCTTATGGATCAGAGTGTAACAGAGGTGCCTGATGTGATGGAAGGATCCAATCCCCCATATTACACTGATACAACATTAGCAGTTTCAACATTTGCGAAGTTGTCTTCTCAGACACCATCATCTCCCCTCACTATCTACTCAGGCAGTGAAGCCTCTGGACACACAGAGATCCCCCAGCCCAGTGCTCTGCCAGGAATAGACGTCGGCTCATCTGTAATGTCCCCACAGGATTCTTTTAAGGAAATTCATGTAAATATTGAAGCGACTTTCAAACCATCAAGTGAGGAATACCTTCACATAACTGAGCCTCCCTCTTTATCTCCTGACACAAAATTAGAACCTTCAGAAGATGATGGTAAACCTGAGTTATTAGAAGAAATGGAAGCTTCTCCCACAGAACTTATTGCTGTGGAAGGAACTGAGATTCTCCAAGATTTCCAAAACAAAACCGATGGTCAAGTTTCTGGAGAAGCAATCAAGATGTTTCCCACCATTAAAACACCTGAGGCTGGAACTGTTATTACAACTGCCGATGAAATTGAATTAGAAGGTGCTACACAGTGGCCACACTCTACTTCTGCTTCTGCCACCTATGGGGTCGAGGCAGGTGTGGTGCCTTGGCTAAGTCCACAGACTTCTGAGAGGCCCACGCTTTCTTCTTCTCCAGAAATAAACCCTGAAACTCAAGCAGCTTTAATCAGAGGGCAGGATTCCACGATAGCAGCATC |
| 1239 | VCAN | 2818568 | CTGATCGCTGCAAAATGAACCCGTGCCTTAACGGAGGCACCTGTTATCCTACTGAAACTTCCTACGTATGCACCTGTGTGCCAGGATACAGCGGAGACCAGT |
| 1240 | VCAN | 2818571 | TTGATGAATGTCACTCTAATCCCTGTCGTAATGGAGCCACTTGTGTTGATGGTTTTAACACATTCAGGTGCCTCTGCCTTCCAAGTTATGTTGGTGCACTTT |
| 1241 | VCAN | 2818572 | AAGGGCAGTGCTACAAATACTTTGCCCATCGACGCACATGGGATGCAGCTGAACGGGAATGCCGTCTGCAGGGTGCCCATCTCACAAGCATCCTGTCTCACGAAGAACAAATGTTTG |
| 1242 | VCAN | 2818573 | CCATGATTATCAGTGGATAGGCCTCAATGACAAGATGTTTGAGCATGACTTCCGTTGGACTGATGGCA |
| 1243 | VCAN | 2818577 | TACGAGAATTGGAGACCCAACCAGCCAGACAGCTTCTTTTCTGCTGGAGAAGACTGTGTTGTAATCATTTGGCATGAGAATGGCCAGTGGAATGATGTTCCCTGCAATTACCATCTCACCTATACGTGCAAGAAAGGAACA |
| 1244 | VCAN | 2818578 | ACCTCGTTATGAAATCAACTCCCTGATTAGATACCACTGCAAAGATGGTTTCATTCAACGTCACCTTCCAACTATCCGGTGCTTAGGAAATGGAAGATGGGCTATACCTAAAATTACCTGCATG |
| 1245 | VCAN | 2818579 | GTGGTCCTTTAGAAAGAATGGACTACCGTGCTATAACAACTACTA |
| 1246 | VCAN | 2818580 | TTTTACGGCTGTGGTATCGGCAGTTTAGGGTATGGAGCAA |
| 1247 | VCAN | 2818581 | ATACCAAAGGACTTATTCTATGAAATACTTTAAAAATTCCTCATCAGCAAAGGACAATTCAATAAATACATCCAAACATGATCATCGTTGGAGCCGGAGGT |

TABLE 13-continued

Subtyping Target Sequences

| SEQ ID NO. | Gene | Affy Probeset ID | Sequence |
|---|---|---|---|
| 1248 | VCAN | 2818582 | CCTATCACCTCGAGAAGTAATTATCAGTTGGTTTGGATTTTTGGACCACCGTTCAGTCATTTTG GGTTGCCGTGCTCCCAAAACATTTTAAATGAAAGTATTGGCATTCAAAAAGACAGCAGACAAA ATGAAAGAAAATGAGAGCAGAAAGTAAGCATTTCCAGCCTATCTAATTTCTTTAGTTTTCTATT TGCCTCCAGTGCAGTCCATTTCCTAATGTATACCAGCCTACTGTACTATTTAAAATGCTCAATTT CAGCACCGATGGCCATGTAAATA |
| 1249 | VCAN | 2818583 | CTCAGCCATAGGTGCAGTTTGCTTCTACATGATGCTAAAGGCTGCGAATGGGATCCTGATGGA ACTAAGGACTCCAATGTCGAACTCTTCTTTGCTCATTCCTTTTTCTTCACTTACAAGAAAGGCC TGAATGGAGGACTTTTCTGTAACCAGGAACATTTTTTAGGGGTCAAAGTGCTAATAATTAACT CAACCAGGTCTACTTTTTAATGGCTTTCATAACACTAACTCATAAGGTTACCGATCAATGCATT TCATACGGATATAGACCTAGGGCTC |
| 1250 | VCAN | 2818584 | GTGTTAGCCTTTTACTTTCCTCACACAATTTGGAATCATATAATATAGGTACTTTGTCCCTGATT AAATAATGTGACGGATAGAATGCATCAAGTGTTTATTATGAAAAGAGTGGAAAAGTATATAG CTTTTAGCAAAAGGTGTTTGCCCATTCTAAGAAATGAGCGAATATATAGAAATAGTGTGGGCA TTTCTTCCTGTTAGGTGGAGTGTA |
| 1251 | VCAN | 2818585 | GGCACAAAGGGATTGGCCCAATATTGATTCTTTTTTTATAAAACCTCCTTTGGCTTAGAAGGA ATGACTCTAGCTACAATAATACACAGTATGTTTAAGCAGGTTCCCTTGGTTGTTGCATTAAATG TAATCCACCTTTAGGTATTTTAGAGCACAGAACAACACTGTGTTGATCTAGTAGGTTTC |
| 1252 | TGFBI | 2829948 | GGAGGCGCTCTCACTTCCCTGGAGCCGCCCGCTTGCCCGTCGGTCGCTAGCTCGCTCGGTGCG CGTCGT |
| 1253 | TGFBI | 2829949 | CTCTTCGTGCGGCTGCTGGCTCTCGCCCTGGCTCTG |
| 1254 | TGFBI | 2829950 | GCCGCGACCCTGGCGGGTCCCGCCAAG |
| 1255 | TGFBI | 2829951 | GTGCTGCAGCACAGCAGGCTCCGGGGCCGCCAGC |
| 1256 | TGFBI | 2829952 | GTGCAGAAGGTTATTGGCACTAATAGGAAGTACTTCACCAACTGCAAGCAGTGGTACCAAAG GAAAAT |
| 1257 | TGFBI | 2829958 | GTCATCAGCTACGAGTGCTGTCCTGGATATGAAAGGTCCCTGGGGA |
| 1258 | TGFBI | 2829959 | CTACCACTCTCAAACCTTTACGAGACCCTGGGAGTCGTTGGATCCACCACCACTC |
| 1259 | TGFBI | 2829960 | GAGGGGCCCGGCAGCTTCACCATCTTCGCCCCTAGCAACGAGGCCTGGGCC |
| 1260 | TGFBI | 2829961 | ATGACCTCCGTCTGCCCGGGGACT |
| 1261 | TGFBI | 2829962 | TCTTACCAGGTTGCGTCTAATGCCCCCGTTCCCTACTGGGCAGAAAGACTTGGGTGCTTCCT GAGGAGGGATCCTTGGCAGAAGAGAGGCCTGGGCTCACGAGGGCTGAGAACATGTTTCCCA GAGTTGCAAGGACCCATCTCTTAAACACAGAGTCTGCAGCC |
| 1262 | TGFBI | 2829963 | GCAATGTCAACATTGAGCTGCTCAATGCCCTCCGCTACCATATGGTGGGCAGGCGAGTCCTGA CTGATGAGCTGAAACACGGCATGACCCTCACCTCTATGTA |
| 1263 | TGFBI | 2829964 | TGCTGAAAGCCGACCACCATGCAACCAACGGGGTGGTGCACCTCATCGATAAGGTCATCTCC ACCATCACCAACAACATCCAGCAGATCATTGAGATCGAGGACACCTTTG |
| 1264 | TGFBI | 2829965 | GACATTCAGCTTGACCTAACCTGTGAAATTCTCCATCTTCTTTATAAAGTGTTCCCTTCCTTGCC TCCCCTGGAAAGGTCAGTGGTGTGTGGCTGCAGCAGCACAGTGTCCTCTGAGCCCTGGACCT GCACTGTGGCTTCCAGAGGTGGCAGTTCCCACATGGGGTACTAGAATAAATG |
| 1265 | TGFBI | 2829966 | AGAAAATGATGTTCCCACATAGTTGGCAGCACGTGAACAGCAATTGATCCC |
| 1266 | TGFBI | 2829967 | CATCAGGGCTCAACACGATGCTTGAAGGTAACGGCCAGTACACGCTTTTGGCCCCGACCAAT GAGGCCTTCGAGAAGATCCCTAGTGAGACTTTGAACCGTATCCTGGGCGACCCAGA |
| 1267 | TGFBI | 2829968 | TGCCTCATTTGTGCAGCTAGATTGAGCCCAAGACCTGCTCTGGTCCAAGATGAACATACCACC TGCCATGAGGTGACCCTCAGGATATCCACTGCAGCCATGGGCTGGGGTCATCCTGTCCTGTTG CTTCAGCTAACCGTGTCTCTAGCAGCCACACTACTCTGAGGG |
| 1268 | TGFBI | 2829973 | GCAGCGGGACATGCTCACTATCAACGGGAAGGCGATCATCTCCAATAAAGACATCCTAGCC ACCAACGGGGTGATCCACTACATTGATGA |
| 1269 | TGFBI | 2829974 | GAGTCTGATGTGTCCACAGCCATTGACCTTTTCAGACAAGCCGGCCTCGGCAATCATCTCTCT GGAAGTGAGCGGTTGACC |
| 1270 | TGFBI | 2829975 | ATCTCTCTGGACCTAACCATCACCCTT |
| 1271 | TGFBI | 2829976 | ACAAGGAATTTGCTTCGGAACCACATAATTAAAGACCAGCTGGCCTCTAAGTATCTGTACCAT GGACAGACCCTGGAAACTCTGGGCGGCAAAAAACTGAGAGTT |

TABLE 13-continued

Subtyping Target Sequences

| SEQ ID NO. | Gene | Affy Probeset ID | Sequence |
|---|---|---|---|
| 1272 | TGFBI | 2829977 | GTTCTGGGTCCTAAATCATGCTCCTGGGAAGCTCCTTACTGTGGGACTTGTATTAGTGTAAAA AAAAATGTCCTCAATAAGCAGGAGTTTGC |
| 1273 | TGFBI | 2829978 | AAGTACAACTCAACATAGCTCTTGCCTGGGACCAACCAGCACCATTTGGCTAA |
| 1274 | TGFBI | 2829979 | CAGCCTTAATAACCCATCCCAGTGTATACTCCTTCATCTTCATGGATAATGACCCTGCTACATG CTCTGAACAAATCAGGAGGCCCCTCGTGGAAGTATAACCA |
| 1275 | TGFBI | 2829980 | AGAACAGCTGCATCGCGGCCCACGACAAGAGGGGGAGGTACGGGACCCTGTTCACGATGGA CCGGGTGCTGACCCCCCCAATGGGGACTGTCATGGATGTCCTGAAGGGAGACAATCGCTTTA |
| 1276 | TGFBI | 2829982 | GCTGGTAGCTGCCATCCAGTCTGCAGGACTGACGGAGACCCTCAACCGGGAAGGAGTCTACA CAGTCTTTGCTCCCACAAATGAAGCCTTCCGAGCCCTGCCA |
| 1277 | TGFBI | 2829983 | AGATTTGTGGTCATGAACATGTGCTTTGTGTCCTCTGACCATTAGACAGATT |
| 1278 | TGFBI | 2829984 | AGATGCCAAGGAACTTGCCAACATCCTGAAATACCACATTGGTGATGAAATCCTGGTTAGCG GAGGCATCGGGGCCCTGGTGCGGCTAAAGTCTCTCCAAGGTGACAAGCT |
| 1279 | TGFBI | 2829986 | GTGTCAACAAGGAGCCTGTTGCCGAGCCTGACATCATGGCCACAAATGGCGTGGTCCATGTC ATCACCAATGTTCTGCAGCCTC |
| 1280 | TGFBI | 2829988 | TGCCTCTCCTCATGTGTGCATTCACCTTTCTTGGTGCTCTCTCCCCATGGGCCAAGTTCTACCAT GAGTTATGAAACATTATGGAGAAAACATGTCTTTGGAAATGTGAGCCAGAAAGCCCACCAGT GCCCCTCAGTCACGGTTGTTATGAATGACATGCTAATGGTTTCACTCTGGTCAAACCTGCCTTT |
| 1281 | TGFBI | 2829989 | CCAACAGACCTCAGGAAAGAGGGGATGAACTTGCAGACT |
| 1282 | TGFBI | 2829992 | GGAGGAATGCACCACGGCAGCTCTCCGCCAATTTCTCTCAGATTTCCACAGAGACTGTTTGAA TGTTTTCAAAACCAAGTATCACACTTTAATGTACATGGGCCGCACCATAATGAGATGTGAGCC TTGTGCATGTGGGGGAGGAGGGAGAGAGATGTACTTTTTAAATCATGTTCCCCCTAAACATG GCTGTTAACCCACTGCATG |
| 1283 | TGFBI | 2829993 | TTCCAGAGAGGACCTATCCCAAATGTGGAATTGACTGCCTATGCCAAGTCCCTGGAAAAGGA GCTTCAGTATTGTGGGGCTCATAAAACATGA |
| 1284 | TGFBI | 2829994 | TTTTGTAAAGCCCTTGCACAGCTGGAGAAATGGCATCATTATAAGCTATGAGTTGAAATGTTC TGTCAAATGTGTCTCACATCTACACGTGGCTTGGAGGCTTTTA |
| 1285 | TGFBI | 2829995 | TGGTATGTAGAGCTTAGATTTCCCT |
| 1286 | GABRP | 2840395 | TGCGGCTGCAGTCCAGGAATAGTCA |
| 1287 | GABRP | 2840398 | CTGCGTGTCCACATACGAGGGGACAGGGCTGAGGATGAGGAGAACCCTGGGGACCCAGAA GACCGTGCCTTGCCTGGAAGTCCTGCCTGTAGGCCTGAAGGACTTGCCCTAACAGAGCCTCAA CAACTA |
| 1288 | GABRP | 2840400 | CCTACTTCAGCCCCTTGGTGTGAGCAGCTTCTC |
| 1289 | GABRP | 2840401 | GGCCTTCGTGTGTCTGAGTCTCTTCACTG |
| 1290 | GABRP | 2840402 | AGTCAGTTCAACGTCGAGGTCGGCAGAAGTGACAAGCTTTCCCTGCCTGGCTTTGAGAACCTC ACAGCAGGATATAACAAATTTCTCAGGCCCAATTTTGG |
| 1291 | GABRP | 2840404 | GAGAACCCGTACAGATAGCGCTGACTCTGGACATTGCAAGTATCTCTAGCATT |
| 1292 | GABRP | 2840405 | GTAAGCGCTGTTCCTTTGTACTCTACCCAAGTAGTCCCTCTCTGTGTG |
| 1293 | GABRP | 2840406 | TACACAGCCACCATATACCTCCGACAGCGCTGGATGGACCAGCGGCTG |
| 1294 | GABRP | 2840407 | TCCTCTGGGTGCCAGATACTTACATTGTGGAGTCC |
| 1295 | GABRP | 2840408 | TGGGAAACAGGCTCATCCGCCTCTTCTC |
| 1296 | GABRP | 2840411 | CTGTTGCATGTAACATGGATCTGTCTAAATACCC |
| 1297 | GABRP | 2840415 | ACGACTCTGTGCGTGGACTGGAACACCTGCGGCTTGCTCAGTACACCATAGAGCGGTATTTCA CCTTAGTCACCAGATCGCAGCAGGAGA |
| 1298 | GABRP | 2840418 | TACACTAGATTGGTCTTACAGTTTGAGCTTCGGAGGAATGTTCTGTATTTCATTTTGGAAACCT ACGTTCCTTCCACTTTCCTGGTGGTGTTGTCCTGGGTTTCATTTTGGATCTCTCTCGATTCAGTC CCTGCA |

TABLE 13-continued

Subtyping Target Sequences

| SEQ ID NO. | Gene | Affy Probeset ID | Sequence |
|---|---|---|---|
| 1299 | GABRP | 2840419 | ACCACACTGATGATCGGGTCCCGCACTTCTCTTCCCAACACCAACTGCTTCATCAAGGCCATCG<br>ATGTGTACCTGGGGATCTGCTTTAGCTTTGTGTTTGGGGCCTTGCTAGAATATGCAGTTGCTC<br>ACTACAGTTCCTTACAGCAGATGGCA |
| 1300 | GABRP | 2840420 | CTCCAGCTTTAAACGGAAGATCAGCTTTGCCAGCATTGAAATTTCCAGCGACAACGTTGACTA<br>CAGTGACTTGACAATGAAAACCAGCGACAAGTTCAAGTTTGTCTTCCGAGAAAAGATGGGCA<br>GGATTGTTGATTATTTCACA |
| 1301 | GABRP | 2840421 | TTGATTTTTATGCTAGCCAATGTATTTTACTGGGCATACTACAT |
| 1302 | GABRP | 2840422 | CTCAGGGCTGTTTATTCGGTGGCTCCCTGGTTTGCATTTACCTCATATAAAGAATGGGAAGGA<br>GACCATTGGGTAACCCTCAAGTGTCAGAAGTTGTTTCTAAAGTAACTATACATGTTTTTTACTA<br>AATCTCTGCAGTGCTTATAAAATACATTGTTGCCTATTTAGGGAGTAACATTTTCTAGTTTTTGT<br>TTCTGGTTAAAATGAAATATGGGCTTATGTCAATTCATTGGAAGTCAATGCACTAACTAATAC<br>CAAGATGAGTTTTTAAATAATGAATATTATTTAATACCAACACAGAATTATCCCCAATTTCCAA<br>TAAGTCCTATCATTGAAAATTCAAATATAAGTGAAGAAAAAATTAGTAGATCAACAATCTAAA<br>CAAATCCCTCGGTTCTAAGATACAATGGATTCCCCATACTGGAAGGACTCTGAGGCTTTATTCC<br>CCCACTATGCATATCTTATCATTTTATTATTATACACACATCCATCCTAAACTATACTAAAGCCC<br>TTTTCCCATGCATGGATGGAAATGGAAGATTTTTTTTTAACTTGTTCTAGAAGTCTTAATATGG<br>GCTGTTGCCATGAAGGCTTGCAGAATTGAGTCCATTTTCTAGCTGCCTTTATTCACATAGTGAT<br>GGGGTACTAAAAGTACTGGGTTGACTCAGAGAGTCGCTGTCATTCTGTCATTGCTGCTACTCT<br>AACACTGAGCAACACTCTCCCAGTGGCAGATCCCTGTATCATTCCAAGAGGAGCATTCATCC<br>CTTTGCTCTAATGATCAGGAATGATGCTTATTAGAAAACAAACTGCTTGACCCAGGAACAAGT<br>GGCTTAGCTTAAGTAAACTTGGCTTTGCTCAGATCCCTGATCCTTCCAGCTGGTCTGCTATGAG<br>TGGCTTA |
| 1303 | SEMA5A | 2847975 | GCTATGCCGCTTGATGTAACTTTTAAAGATGTTATCAAATGTTAAATGCCTCATTCTGCGTTAA<br>TTTGCTGTTGGCTGTTTTGTGAACACAAAATAAACTTGAGATTTTTTTTTTTTTTTTTGTGA<br>AACTCCTCCAAAGCCAATTTCAGCCCTTGGTAAGCTTGCAGACAGTTACTGATCTTAAATTTAA<br>TTTTAAAAGACAATGTATCTTAATTATAATTTAGCTTTTTAAAACAATGAGATAGCTTTACATTT<br>CCCCTTTGTTTGAATGAGAAATGGATCTTGGGTTGCTATGCTAGAACACTTGTAGATTGCTG<br>GGTCCTTTGTAAGGGGGCCATGGACACACCACACTTTCTTTCAATCCTTACATTTGAAGCATTG<br>ATATTCTTCAAAACCTTCTTGTTACATGTGCGCAATAGAAATTTCTAATGTTCATGACTTTTATC<br>TTTCCTGTCCATCAATTCACTGGTTGTAAATGCTTCCTGAGAGCTGTCTAGGTCTGTATCCCAG<br>ATTGTTGCTTAATGACATCTGACAGATGCATTGTTTTCTGAAATCAGCTTAAGACACCAATTGT<br>GGCAACTGGAAACTCATTACCTGCTGCATTGGATCAACTATGGAAGTTGGAGCAGGGGTGGG<br>CGGAGGTCACCTAACCAATCAATGGAAGGCAACTCACACCTGCTCCAAGCCTCAGCTTTGAGA<br>AACAAACACGTTTATAAGAAAAAATATATAGCTATTATTACAGAAGTGAATATGTTGTGCTCT<br>CTTACTGCTCTTGG |
| 1304 | SEMA5A | 2847976 | TTGGCGCAATGGCAGGAACTAGTCAAGGGCACTTTCAGATCTGGAAAGAGGAAAGAGGAGG<br>TAGAAAATCACTCTTTTGTGTTTCTTAAACTGTCAATCAAGCAAGAAAATTTATTCCACCCCTTC<br>ATATTTGCTCTAAAATCTGGGGCCAGTAGTTGAAATGTGATCTTGTTCTTTCTCAGCCTTTTGG<br>CAATTTAATGCCAAATATTCCAAATGTTAGATGAATGGCAGTAATAAAATGATTCAAATGTTT<br>GATAAATACAAGCTGAGAGCAAAATCTGGACTCTGAAAAATCGGAACTATTTTATCATGTTGC<br>TAAAATGAGAGCATCATTTTCTTCCCTCTCTGTAAGTGCGGTAGTTTA |
| 1305 | SEMA5A | 2847977 | TGCCCAGAGTGCCAGAGTTTTAGCCAAAGGTGTACTTACTTCCTTATTTATCTGCAAAAGGAT<br>GGAAACTGTGGGAGTCAAAGCCTATTTTGCTGAGTGTTCCCACTGGAGTCTCTGGTAGAATTA<br>GCAGGTCATGCTGTCAAAATCATGGACAAAGGCTGGGTGCAGTGGCTCATGCCTATAATCCC<br>AGCACTTTGGGAGGCCAAGGTGGGCGGATCACCTGAGCTCAGGAGTTTGAGACCAGCCTGG<br>GCAACATGGGGAAACTCCATCTCTACAAAATATACAAAATATTAGCCAGCATCGTGGTGCGT<br>GCCTGTGGTCCCAGTTTCTTGGGAGGCTGAGGCGGGAGTATCATTTGAGCCAGGAGGTTGAG<br>GTTGCAGTGAGCTGAGATCACATCACTGCACTCCATCCTGGGTGACAGAGAGAGACCCTGTC<br>TCAAAAAAAAAAAAAAAGAACAAAGTCTTAGCGGGGGTCTCTATGTCCCCAAGTGGCTCTC<br>TAAGGGGATCCATTAGCGTATAATTGAATATCAAAGGGAATTTTACCTTAAACATATATCAAG<br>TCTATACTCAGCTAATCGTTTTGTCTAAACACAGCCTTGTTAGCATTTGAATTTACAAATATTCA<br>TTTGCTTATTTGCAGTGTTCCTTTTGCTTTTAGAATAAATCATAAATATTTCCCCAATACTGTCA<br>AGATACTTCTTCAACTTTGTCCCTGAACCATCAGCTTTCTTTAGGGTCCGGGTATCCTTTACACT<br>TCAATG |
| 1306 | SEMA5A | 2847978 | GAAGAGTCCGTTCATGTCATGTGGTTTGGGATGAACCAGGGGTCTGGCCCCATCGGGTCACA<br>GGTGATGGCAAATAGAAAAGAAGCAAATGGAGGGAAATAGTCGGATAAGTA |
| 1307 | SEMA5A | 2847979 | GCTGGCTTGGCTTTAGTCTTACATTTAAATTCTTTGAAAGTGGCTCCCAGTGCTATTCAGGGTC<br>CTTTCTTGAGGCCAGACTCATCACCATCTACTATTGATTTTACAGTGCACTGACAGTTTACAGG<br>AAGGAGAAGAACAGAATTTCTGCACACTACACAACATGTGGGCTTCCTGTAGCTCCAGGGAC<br>ATGTAGCTTTGGTGAAACTGGGGTTTTGTAACCTCTGAATGATATGGACTTAGTGAATTCTAA<br>GGAACTCAGGGGGCACGTGGTCAGGCTCCACCGCACAGAAGAGCCACAGTCTCCAGACTCAT<br>GGCGTTCCCTCCAGAACTCCCCATTCCCCTCTGAGCATATTTCTATGCTGCTGCTTCTTGTGACT<br>TACATGAGGCATCTCAGCTTCTTCATGTTTGTAGGGATGGTTCCCTAAGCCTGTTCAAGTA |
| 1308 | SEMA5A | 2847980 | ACCTGGTCCACACCGGCAGAAGTTACAGTAGACTGTGAGGCACCCCACCTTGCTCCTGATGCA<br>GTTTCTGTGCCATTGCTGGTGCTGGTGGAGGCAGCGGAGCAGAGGCTCAGGCACAATGAAG |

TABLE 13-continued

Subtyping Target Sequences

| SEQ ID NO. | Gene | Affy Probeset ID | Sequence |
|---|---|---|---|
| | | | CGTGGATGTGTTCTGCAGGTTGCTGCAAAACTCACCTTATTCTGACTTTTGGATTTCATGGCAT<br>TCCAGGAAGCTCCTTGCCATGCTGTTGGCCTGGAAGTCCACCTGTCTGGTCCATAGTGACGTC<br>CTGAAGAGCCAGTCTGTAAAATAACCAACCACTTACTTAGCGTTTGGATAGACTCCATGCCTT<br>CTCTCTCCCTGCAAAGAAAATCTTGAACATTTATGATGTCAATTAGTGAAAGTATTGAAAATA<br>CTAAATTATAACTAAAAGCAACTTTTTATGTTATTGAAAATATTGAAAGAACTGATATTAATGA<br>TAATCATTTTATTTTTCATCTCTCTGATATACCCAATGTGTGGCAATCAGCCCCTACCACGAGCA<br>TTAATACCATGTAAAGCTGGCTTTCTGGAGTCTGCCAGGTCCACACGAAGTGCTACCCCCAGT<br>TTCTGCTGTTACTTGCTGCCTCCAGGCCAGGGGAGCAGGAGATGCTCAGCTCTGGTGCCTTTT<br>CTTTTATTTCAGTGCTGCCTTCCCACCCACCCAGTCCATTCACCCTCACCTCTCCCTGCATGGAG<br>GCAACAGCATTTCAAGATGTACCTTGGGAAGTCAGGATAGCTGGAAGTAAGGGTTTTTGGGA<br>TCCCTGTGGTCTCTTCACTGATCATCGATAAGCATTTAAGAGTGTGCTAACACCATTCACAGAG<br>GTCCCTGGAAAAAATATATAATTTTCTCACAAACAACCAATACATAACCTATGGCAGTTGGTT<br>GAATAATTATTGAAAAAAGAACACGACTGAAAAAGTTCATCTGATGCCTCTGAGCATGTGAT<br>AAAGTCCTGGGTAGACACGAAACGTGTTCTTACAAATGAACCTTCGGATCTATGAAAGAAA<br>ATATAGTAGGGGGACTAAGGAACATAGAATTTTATTAGCATATGTGATTTTACCCTTATCTTTG<br>TTTCTAATTTAAAGAAACAATTTCAGAAAGTGTTAGAAGAATTCTATGTTTAATAATGAATATT<br>GTTGAGTTCAAAATATTCTCATATACCCAGATTTACAGAGATGACACAGTATTGAAATGGCAG<br>GTGGGCTCTGTAAGTTATTTTGGATTAATGACATTCAGGGTCTTTGCAGTGGGGACTTCATGT<br>TGCCTCTCACTCATTCCTCATATGTCAGAGTCTTCTGTCTATATGCACATGCTCAAAGTCCTAC<br>TCAGTAGGGGAAATCTAGCCGGATGGTTCTCCAATTGTTCC |
| 1309 | SEMA5A | 2847981 | CAAAAACAACTTGATCCTAGAGGAAAGAAACAAATACTTCAACCCACATCTCACTGGGAAGA<br>CCTATTCTAATGCCTACTTTACAGATCTCAATAATT |
| 1310 | SEMA5A | 2847983 | ACATGTTCCACATGATCGCCGTGGGGCTGAGCAGCTCCATCCTCGGCTGCCTCCTCACCCTGC<br>TCGTCTATACTTACTGCCAGCGGTACCAGCAGCAATCCCACGATGCGACTGTCATCCACC |
| 1311 | SEMA5A | 2847987 | ATCGTGGCAAGATCCAGTAGCGTAGAAGAGAAAAG |
| 1312 | SEMA5A | 2847988 | TGTGAAGCCTCTGGCGTCCAAGTCCGCGCCCGCCAGTGCATCCTCCTGTTCCCCATGGGCAGC<br>CAGTGCTCCGGGAACACCACGGAGAGCCGGCCGTGTGTGTTTGACTCTAATTTCATCCCAG |
| 1313 | SEMA5A | 2847989 | GCACACAGAAGAGGCACTCTGCAACACGCAGCC |
| 1314 | SEMA5A | 2847990 | TGAGGACCCGCTCTTGCTCCAATCCAG |
| 1315 | SEMA5A | 2847991 | ATGGCGTGTGGTCTTGCTGGTCCCCCTGGACAAAATGTTCAGCAACATGCGGCGGTGGACAC<br>TAT |
| 1316 | SEMA5A | 2847996 | TGGGAGATACTCTGCCCACACGGTCAACGGGCTTGGTCAGCCTGGACGTCGTGGTCACAGT<br>GCAGCCGTGACTGCAGCAGGGGCATTCGGAACCGGAAGCGTGTTTGCAACAACCCCGAACCC<br>AAGTATGGGGGAATGCCTTGCCTTGGCCCATCTCTGGAATACCAGG |
| 1317 | SEMA5A | 2847997 | GGCGGCCACTATGAGCAACGATTCCGATACACATGCAAAGCCCGCCTGGCTGATCCGAATTT<br>GCTGGAAGTGGGAAGACAGAGAATCGAAATGCGGTACTGTTCTAGCGACGGCACCA |
| 1318 | SEMA5A | 2848011 | TGGGAACGGTGCACAGCCCAATGCGGGGGTGGCATTCAAGCTCGCCGCAGGATCTGTGAGA<br>ATGGGCCTGACTGTGC |
| 1319 | SEMA5A | 2848012 | CTATGTCCCCCACACATGTTCTGGAC |
| 1320 | SEMA5A | 2848021 | ATCGGCTTCCAGGTGCGGCAGCGCTCCTGCAGCAACCCCACTCCCAGGCACGGGGGCCGGGT<br>GTGCGTGGGACAGAACCGCGAGGAAAG |
| 1321 | SEMA5A | 2848024 | TCTCACCGTGGATGGGCACTTTGGTGTGTGGTCTCCGTGGACGCCTTGCACGCACACAGATG<br>GCAGCGCCGTGGGATCCTGCCTCTGTCGAACCCGCTCCTGCGACAGCCCGGCCCCGCAGTGT<br>GGTGGCTGGCAGTGCGAGGGCCCTGGCATGGAGATCGCCAACTGTTC |
| 1322 | SEMA5A | 2848029 | AGGAGAGCCTGAGCATGACGCAGTGGGAACA |
| 1323 | SEMA5A | 2848031 | CCCTGAATCAGACCTCAAGCAGCTGTTTGCTGGAAGAGATTGAGCTCTTCCCTGAGAGGCGG<br>AGGGAGCCCATCAGGAGCCTGCAGATCCTGCACAGCCAGAGTGTCCTGTTCGTGGGCCTGCG<br>GGAGCACGTGGTCAAGATCCCCCTGAAGAGGTGCCAGTTCTACCG |
| 1324 | SEMA5A | 2848041 | GTGAACCTGACCGAGAGAAATCTGCAGGATGCTCAGAAGTTCATTCTGATGCATGAGGTGGT<br>ACAGCCAGTGACCACAGTGCCCTCCTTCATGAGGACAATAGCCGCTTTTCCCACGTGGCAGT<br>CGACGTGGTGCAGGGCAGAGAAGCGCTCGTCCACATCATCTA |
| 1325 | SEMA5A | 2848044 | TTTTTCCGAGAAAATGCAGTAGAGCATGACTGTGGGAAAACAGTGTTCTCCAGAGCTGCCCG<br>GGTGTGCAAGAACGATATTGGTGGGCGCTTCCTGCTGGAAGACACCTGGACCACATTCATGA<br>AGGCTCGCCTGAACTGCTCCCGT |

TABLE 13-continued

Subtyping Target Sequences

| SEQ ID NO. | Gene | Affy Probeset ID | Sequence |
|---|---|---|---|
| 1326 | SEMA5A | 2848050 | TGATCAGATCAGTGGCATGGCCCGCTGTCCCTACAGTCCCCAGCACAATTCCACAGCGCTCCT CACAGCTGGTGGGGAGCTCTATGCTGCTACAGCCATGGATTTTCCAGGACGTGATCCTGCCAT TTACCGAAGCCTAGGCATTTTACCTCCTCTCCGCACGGCGCAGTACAACTCCAAATG |
| 1327 | SEMA5A | 2848051 | GGTGGCGACCGGTTATTCACCTGTGGGACCAATGCATTCACGCCTGTCTGCA |
| 1328 | SEMA5A | 2848052 | TGTGATGAAGCTACCAAAAAGGCCTGTTACAGCAAAGGCAAATCAAAG |
| 1329 | SEMA5A | 2848064 | AACTACCTCTTCAGGTTACAGCTTGAGGATCTGT |
| 1330 | SEMA5A | 2848067 | CCCTGGTTACGGGAGTTCAGAGCGAAGAATGCTGTGGATTTCTCGCAGTTAACATTTGACCCA GGACAGA |
| 1331 | SEMA5A | 2848077 | ACCTGTGTTATAGCATGGCTGTTCTCAAGCCTGGGGCTGTGGAGACTCGCCCACCCAGAGGC CCAGGGTACGACTCAGTGCCAGAGAACCGAGCATCCAGTCATC |
| 1332 | SEMA5A | 2848078 | AAGACACGTGCCCAGAGTCAGAGGCCCCTTGCCCA |
| 1333 | SEMA5A | 2848083 | GTTGGTGTGTGAGACTTGGGCTGGAGTGCCCACGTGGCTGTGGAGTCAGTGTGATTCATGAT TGAGGAAACGCGTCCTCCATCCTC |
| 1334 | SEMA5A | 2848088 | GAGCTGGCTTGGACACCCAACTTTGCCACCTCGAGGGTCGTCTCTGCTGGGCGCGAACCTGCC CACCCACCGGTTGGCCGCGCGCTCGGGGACCGTGCTCGTGGCCCCCAAGCCGGTGCCCCCAT TCTGGAACTCAGCGAGTAGGGGGCGGCTCTGGGGAAGTGGCAGGGGGCGGCTGCAGCTGC TGCCTCCACTTCCCTAGCCAGGTGCTGAAGAGGATCCTCGGAGCCGCTCTGGCCCCCAGGCGC TGGATGACTGGCACCAGCGCTCCTC |
| 1335 | SEMA5A | 2848106 | CGTGCTCATGGGAAACAAACGACTCCAGGGTGTGTGCCGCCGATTTGCAATATGAGGCTGAT CTACTGTTCCCACTGTTTTATTCCCTGCTGCTATATCTCGGCTGGGAAATGTACGCTGTGGACC CCGCATCTTCATAATGATGGTCCCTCAATGATCAACCACCTTCCACGTAGCATCCATACAGTAG TC |
| 1336 | RNF138P1 | 2857253 | AAGAAACTCAATGTCAAACTGCTGTTGAA |
| 1337 | PPARG | 2878248 | ACAACATCCGGGAGATGCTGATGGC |
| 1338 | SPINK1 | 2880429 | GGCCTTATTGTTGAATAAATGTATCTGAATA |
| 1339 | SPINK1 | 2880430 | AACCAAGGTTTTGAAATCCCATCAGGTCACC |
| 1340 | SPINK1 | 2880433 | AGCAACTGAAACCTTAGCATGTCTCAAGCATCATGCTAATATTCCCTGTCTTACTTGTGCTTAT GACTAAGAAAACATCATGAGCATGTATAGGATGGCTTCTTATAACTTGGGGCAAATGCCAGA AGATGAGGTGTAAATAAAGTGCAACAGGAGTGAAGCAGAGATACATATTTTTTATTAAAAGG GGCCAAGAAAGGATCCATGAAAAGAATAGAATGCCAGCCGGGTGC |
| 1341 | SPINK1 | 2880434 | CAATGAACTTAATGGATGCACCAAGATATATGACCCTGTCTGTGGGACTGATGGAAATACTTA TCCCAATGAATGCGTGTTATG |
| 1342 | SPINK1 | 2880435 | TAACACTGGAGCTGACTCCCTGGGAAGAGA |
| 1343 | SPINK1 | 2880439 | ATGAAGGTAACAGGCATCTTTCTTCTCAGTGCCTTGGCCCTGTTGAGTCTATCTG |
| 1344 | SPINK1 | 2880452 | TGGAGGCCAGGCTATGACACAGAGTCAATCAATAACCAGGGAGATCTGTGATATAGCCCAGT AGGTGGGGCCTTGCTGCCATCTGCCATATGACCCTTCCAGTCCCAGGCTTCTGAAGAGACGTG GTAAGTGCGGTGCAGTTTTCAACTGACCTCTGGACGCAG |
| 1345 | CD74 | 2881377 | ATAATCCTTTCTGCCGACCCCTAGT |
| 1346 | CD74 | 2881378 | TTTCTAGCCTATTTACCTGCAGGCTGAGCC |
| 1347 | CD74 | 2881379 | AGTGGCCAAAAGCTAGACAGATCCCCGTTCCTGACATCACAGCAGCCTCCAACACAAGGCTCC AAGACCTAGGCTCATGGACGAGATGGGAAGGCACAGGGAGAAGGGATAACCCTACACCCAGA |
| 1348 | CD74 | 2881380 | CTGGCTCTTTCGTCACCCTTGGACAAGACAAACCAAGTCGGAACAGCAGATAACAATGCAGC AAGGCCCTGCTGCCCAATCTCCATCTGTCAACA |
| 1349 | CD74 | 2881381 | GCAGCAGAGGCGGTCTTCAACATCCTG |
| 1350 | CD74 | 2881382 | GTGGGGAGTTACACAAATCCATGATGGTCATTATTGGACCTGAGCAGGGGGCAGGGGAGGG TGGACAGTCCTTAACTGCTCTGCAGGTCCAGGATGTTAGAAAGGGGCAGGGACAACAAATG GGTGACCCCAACCTCAACCTG |
| 1351 | CD74 | 2881383 | TGGGCCACTCTCCAACATTCCTGGGATGTCCATTTCA |

TABLE 13-continued

Subtyping Target Sequences

| SEQ ID NO. | Gene | Affy Probeset ID | Sequence |
|---|---|---|---|
| 1352 | CD74 | 2881384 | GAACTGGAGGACCCGTCTTCTGGGC |
| 1353 | CD74 | 2881386 | CCCAAGTGCGACGAGAACGGCAACTATCTGCCACTCCAGTGCTATGGGAGCATCGGCTACTG CTGGTGTGTCTTCCCCAACGGCACGGAGGTCCCCAACACCAGAAGCCGCGGGCACCATAACT GCAGTG |
| 1354 | CD74 | 2881387 | AGTGCCAGGAAGAGGTCAGCCACATCCCTGCTGTCCACCCGGGTTCATTCAG |
| 1355 | CD74 | 2881391 | TTTGAGAGCTGGATGCACCATTGGCTCCTGTTTGAAATGAGCAGGCACTCCTTGGAGCAAAA GCCCACTGACGCTCCA |
| 1356 | CD74 | 2881393 | TACCCGCCACTGAAGGGGAGCTTCCCGGAGAACCTGAGACACCTTAAGAACACCATGGAGAC CATAGACTGGAA |
| 1357 | CD74 | 2881395 | CTCTGGATTACTGAATACAAGGGTGACCCTTAAATGTTATATGTAGTCTGGCCTCTGCATTTTT GAGATAAACAGGCTCGGCTGGGT |
| 1358 | CD74 | 2881396 | AATGCCACCAAGTATGGCAACATGACAGAGGACCATGTGATGCACCTGCTC |
| 1359 | CD74 | 2881398 | AGCCTGTGAGCAAGATGCGCATGGCCACCCCGCTGCTGATGCAGGCGCTGCCCATGGGAGC |
| 1360 | CD74 | 2881399 | TCTCCCTCCGGTTTGGAATTCCAGCCCTTCCTCATCTGGGTCTGATACCCTCCTCCCTGGGCAC CGGGGCCACACTTACCCTCGTTCCTGTCC |
| 1361 | CD74 | 2881400 | CCGCCTACTTCCTGTACCAGCAGCAGGGCCGGCTGGACAAACTGACAGTCACCTCC |
| 1362 | CD74 | 2881401 | AGGCTTTTCCATCCTGGTGACTCTGCTCCTCG |
| 1363 | CD74 | 2881407 | GATGACCAGCGCGACCTTATCTCCAACAATGAGCAACTGCCCATGCTGGGCCGGCGCCC |
| 1364 | CD74 | 2881408 | AGCAGGAGCTGTCGGGAAGATCAGAAGCCAGTC |
| 1365 | CD74 | 2881409 | CGGAGTGGCCTTCTGTGGACGAATCAGATTCCTCTCC |
| 1366 | DUSP1 | 2887311 | TGGGACTCCATGCTCCTTGAGAGGAGAAATGCAATAACTCTGGGAGGGGCTCGAGAGGGCT GGTCCTTATTTATTTAACTTCACCCGAGTTCCTCTGGGTTTCTAAGCAGTTATGGTGATGACTT AGCGTCAAGACATTTGCTGAACTCAGCACATTCGGGACCAATATATAGTGGGTACATCAAGTC CATCTGACAAAATGGGGCAGAAGAGAAAGGACTCAGTGTGTGATCCGGTTTCTTTTTGCTCG CCCCTGTTTTTTGTAGAATCTCTTCATGCTTGACATACCTACCAGTATTATTCCCGACGACACAT ATACATATGAGAATATACCTTATTTATTTTTGTGTAGGTGTCTGCCTTCACAAATGTC |
| 1367 | DUSP1 | 2887312 | CAGGCAGGCATTTCCCGGTCAGCCACCATCTGCCTTGCTTACCTTATGAGGACTAATCGAGTC AAGCTGGACGAGGCCTTTGAGTTTGTGAAGCAGAGGCGAAGCATCATCTCTCCCAACTTCAG CTTCATGGGCCAGCTGCTGCAGTTTGAGTCCCAGGTGCTGGCTCCGACTGTTCGGCAGAGG CTGGGAGCCCCGCCATGGCTGTGCTCGACCGAGGCACCTCCACCACCACCGTGTTCAACTTCC CCGTCTCCATCCCTGTCCACTCCACGAACAGTGCGCTG |
| 1368 | DUSP1 | 2887314 | CTGGTTCAACGAGGCCATTGACTTCATAG |
| 1369 | DUSP1 | 2887315 | GCCTTGATCAACGTCTCAGCCAATTGTCCCAACCATTTTGAGGGTCACTACCAGTACAAGAGC ATCCCTGTG |
| 1370 | DUSP1 | 2887316 | TGCCCTTTCTGTACCTGGGCAGTGCGTATCACGCTTCCCGCAAGGA |
| 1371 | DUSP1 | 2887318 | GATACGAAGCGTTTTCGGCTTCCTGCCCGGAGCTGTGCAGCAAACAGTCGACCCCCATGGGG CTCAGCCTTCCCCTGAGTACTAGCGTCCCTGACAGCGCGGAATCTGGGTGCA |
| 1372 | DUSP1 | 2887320 | TGGACTGCCGCTCCTTCTTCGCTTTCAACGCCGGCCACATCGCCGGCTCTGTCAACGTGCGCTT CAGCACCATCGTGCGGCGCCGGGCAAGGGCGCCATGGGCCTGGAGCACATCGTGCCCAAC GCCGAGCTCCGCGGCCGCCTGCTGGCCGGCGCCTACCACGCCGTGGTGTTG |
| 1373 | DSP | 2893795 | AGCGAGCAGCGACCTCGCGAGCCTTCCGCACTCCCGCCCGGTTCCCCGGCCGTCCGCCTATCC TTGGCCCCCTCCGCTTTCTCCGCGCCGGCCCGCCTCGCTTATGCCTCGGCGCTGAGCCGCTCTC CCGATTGCCCGCCGA |
| 1374 | DSP | 2893796 | ACGGAGGCTCCCACCCGCGGATCAACACTCTGGGCCGCATGATCCGCGCCGAGTCTGGCCCG GACCTGCGCTACGAGGTGACCAGCGGC |
| 1375 | DSP | 2893797 | CAGGATGTACTATTCTCGGCGCGGCGTGATCACCGACCAGAACTCGGACG |
| 1376 | DSP | 2893800 | TCAAACCGGCACGATGTCCAGGCACCAGAACCAGAACACCATCCAGGAGCTGCTGCAGAACT GCTCCGACTGCTTGATGCGAGCAGAGCTCATCGTGCA |

TABLE 13-continued

Subtyping Target Sequences

| SEQ ID NO. | Gene | Affy Probeset ID | Sequence |
|---|---|---|---|
| 1377 | DSP | 2893801 | GGAGATGGAATACAACTGACTCGGAGTCGAGAATTGGATGAGTGTTTTGCCCAGGCCAATGACCAAATGGAAATCCTCGACAGCTTGATCAGAGAGATGCGGCAGATGGGCCAGCCCTGTGATGCTTACCAGAAAA |
| 1378 | DSP | 2893802 | GAGCAAATGCGAGCCCTTTATAAAGCCATCAGTGTCCCTCGAGTCCGCAGGGCCAGCTCCAAGGGTGGTGGAGGCTACACTTGTCAGAGTGGCTCTGGCTGGGATGAGTTCACCAAACATGTCACCAGTG |
| 1379 | DSP | 2893805 | CGCGAGAAATCTGCTATCTACCAGTTGGAGGAGG |
| 1380 | DSP | 2893807 | GAACATCATTCAGGCCACGTCCAGGGAGATCATGTGGATCAATGACTGCGAGGAGGAGGAGCTGCTGTACGACTGGAGCGACAAGAACACCAACATCGCTCAGAAACAGGA |
| 1381 | DSP | 2893808 | AAAGAGCTCAATAAGCTGAAACAAGAA |
| 1382 | DSP | 2893809 | GTTGGATTCTTCAGATCACCAAGTGCATTGATGTTCA |
| 1383 | DSP | 2893810 | TTTGAAGAGGCGCAGTCTACTGAAGCATACCTGAAGGGGCTCCAGGACTCCATCAGGAAGAAGTACCCCTGCGACAAGAACATGCC |
| 1384 | DSP | 2893811 | TCCTTGAATACAAGCGTCAGGTGCAGAACTTGGTAAACAAGTCTAAGAAGATTGTACAGCTGAAGCCTCGTAACCCAGACTACAGAAGCAATAAACCCATTATTCTCAGAGCTCTC |
| 1385 | DSP | 2893812 | TGCATAAGGGGGATGAGTGTATCCTGAAGGACAACAACGAGCGCAGCAAGTGGTACGTGACGGGCCCGGGAGGCGTTGACATGCTTGTTCCCTCTGTGGGGCTGATCATCCCTCCTCCGAACCCA |
| 1386 | DSP | 2893813 | GATTGAGCAGTACTACGAAGCCATCTTGGCTCTGTGGAACCAGCTCTACATCAACATGAAGAGCCTGGTGTCCTGGCACTACTGCATGATTGACATA |
| 1387 | DSP | 2893814 | CGATAGCCGACCTTGAGTTACATTACCAAGAGTTCATCAGAAATAGCCAAGGCTCAGAGATGTTTGGAGATGATGACAAGCGGAAAATACAGTCTCAGTTCACCGATGCCCGAAAGCATTACCAGACCCTG |
| 1388 | DSP | 2893816 | TTCACAAGCAATTGCTGAGGTTCTCAACCAGCTTAAAGATATGCTTGCCAACTTCAGAGGTTCTGAAAAGTACTGCTATTTACAGAATGAAGTATTTGGACTA |
| 1389 | DSP | 2893817 | GACATGTTAAAGGTTTATGAAGCCAGGCTCACTGAGGAGGAAACTGTCTGCCTGGACCTGGATAAAGTGGAAGCTTACCGCTGTGGACTGAA |
| 1390 | DSP | 2893818 | ACTTGAAGAAGTCGTTGTTGGCCACTATGAAGACAGAACTACAGAAAGCCCAGCAGATCCACTCTCAGACTTCACAGCAGTATCCACTTTATGATCTGGACTTGGGCAAGTTCGGTGAAAAAGTCACACAGCTGACAGACCGCTGGCAAAGGATA |
| 1391 | DSP | 2893819 | CGTGATAACTATCAGGCTTTCTGCAAGTGGCTCTATGATGCTAAACGCCGCCAGGATTCCTTAGAATCCATGAAATTTGGAGATTCCAACACAGTCATGCGGTTTTTGAATGAGCA |
| 1392 | DSP | 2893821 | GCTGGCCTCATACACCTCAGGACTGGAAACTCTGCTGAACATACCTATCAAGAGGACCATGATTCAGTCCCCTTCTGG |
| 1393 | DSP | 2893822 | TGCAGATGTTCATGCTCGGTACATTGAACTACTTACAAGATCTGGAGACTATTACAGGTTCTTAAGTGAGATGCTG |
| 1394 | DSP | 2893823 | TCAGACTGGCCCGAGATGCCAACTCGGAAAACTGTAATAAGAACAAATTCCTGGATCAGAACCTGCAGAAATACCAGGCAGAGTGTTCCCAGTTCAAAGCGAAGCTTGCGAGCCTGGAGGAGCTGAAGAGACAGGCTGAGCTGGATGGAAGTCGGCTAAGCAAAATCTAGACAAGTGCTACGGCCAAATAAAAGAACTCAATGAGAAGATCACCCGACTGACTTATGAGATTGAA |
| 1395 | DSP | 2893824 | GGCGAGCTGAAGAAAACGCCCTTCAGCAAAAGGCCTGTGGCTCTGAGATAATGCAGAAGAAGCAGCATCTGGAGATAGAACTGAAGCAGGTCATGCAGCAGCGCTCTGAGGACAATGCCCGGCACAAGCAGTCCCTGGAGGAGGCTGCCAAGACCATTCAGGACAAAAATAAGGAGATCGAGAGACTCAAAGCTGAGTTTCAGGAGGAGGCCAAGCGCCGCTGGGAATATGAAA |
| 1396 | DSP | 2893825 | GTAAGAAACAATTATGATGAGGAGATCATTAGCTTAAAAAATCAG |
| 1397 | DSP | 2893826 | TTTGAGACCGAGATCAACATCACCAAGACCACCATCC |
| 1398 | DSP | 2893827 | GCTACCGGGCTCAGATAGACAATCTCACCCGAGAAAACAGGAGCTTATCTGAAGAAATAAAGAGGCTGAAGAACACTCTAACCCAGACCACAGAGAATCTCAGGAGGGTGGAAGAAGACATCCAACAGCAAAAGGCCACTGGCTCTGAGGTGTCTCAGAGGAAACAGCAGCTGGAGGTTGAGCTGAGACAAGTCACTCAGATGCGAACAGAGGAGAGCGTAAGATATAAGCAATCTCTTGATGATGCTGCCAAAACCATCCAGGATAAAAACAAGGAGATAGAAAGGTTAAAACAACTGATCGACAAAGAAACAAATGACCGGAAATGCCTGGAAGATGAAAACGCGAGATTACAAAGGGTCCAGTATGACCTGCAGAAAGCAAACAGTAGTGCGACGGAGACAATAAACAAACTGAAGGTTCAGGAGCAAGAACTGACACGCCTGAGGATCGACTATGAAAGGGTTTCCCAGGAGAGGACTGTGAAGGAC |

TABLE 13-continued

Subtyping Target Sequences

| SEQ ID NO. | Gene | Affy Probeset ID | Sequence |
|---|---|---|---|
| | | | CAGGATATCACGCGGTTCCAGAACTCTCTGAAAGAGCTGCAGCTGCAGAAGCAGAAGGTGG AAGAGGAGCTGAATCGGCTGAAGAGGACCGCGTCAGAAGACTCCTGCAAGAGGAAGAAGCT GGAGGAAGAGCTGGAAGGCATGAGGAGGTCGCTGAAGGAGCAAGCCATCAAAATCACCAA CCTGACCCAGCAGCTGGAGCAGGCATCCATTGTTAAGAAGAGGAGTGAGGATGACCTCCGG CAGCAGAGGGACGTGCTGGATGGCCACCTGAGGGAAAAGCAGAGGACCCAGGAAGAGCTG AGGAGGCTCTCTTCTGAGGTCGAGGCCCTGAGGCCGCAGTTACTCCAGGAACAGGAAAGTG TCAAACAAGCTCACTTGAGGAATGAGCATTTCCAGAAGGCGATAGAAGATAAAAGCAGAAGC TTAAATGAAAGCAAAATAGAAATTGAGAGGCTGCAGTCTCTCACAGAGAA |
| 1399 | DSP | 2893828 | AATCCAGCCATTCCTTCGGGGTGCAGGATCTATCGCTGGAGCATCTGCTTCTCCTAAGGAAAA ATACTCTTTGGTAGAGGCCAAGAGAAAGAAATTAATCAGCCCAGAATCCACAGTCATGCTTCT GGAGGCCCAGGCAGCTACAGGTGGTATAATTGATCCCCATCGGAATGAGAAGCTGACTGTCG ACAGTGCCATAGCTCGGGACCTCATTGACTTCGATGACCGTCAGCAGATATATGCAGCAGAA AAAGCTATCACTGGTTTTGATGATCCATTTTCAGGCAAGACAGTATCTGTTTCAGAAGCCATCA AGAAAAATTTGATTGATAGAGAAACCGGAATGCGCCTGCTGGAAGCCCAGATTGCTTCAGGG GGTGTAGTAGACCCTGTGAACAGTGTCTTTTTGCCAAAAGATGTCGCCTTGGCCCGGGGGCT GATTGATAGAGATTTGTATCGATCCCTGAATGATCCCCGAGATAGTCAGAAAAACTTTGTGGA TCCAGTCACCAAAAGAAGGTCAGTTACGTGCAGCTGAAGGAACGGTGCAGAATCGAACCAC ATACTGGTCTGCTCTTGCTTTCAGTACAGAAGAGAAGCATGTCCTTCCAAGGAATCAGACAAC CTGTGACCGTCACTGAGCTAGTAGATTCTGGTATATTGAGACCGTCCACTGTCAATGAACTGG AATCTGGTCAGATTTCTTATGACGAGGTTGGTGAGAGAATTAAGGACTTCCTCCAGGGTTCAA GCTGCATAGCAGGCATATACAATGAGACCACAAAACAGAAGCTTGGCATTTATGAGGCCATG AAAATTGGCTTAGTCCGACCTGGTACTGCTCTGGAGTTGCTGGAAGCCCAAGCAGCTACTGG CTTTATAGTGGATCCTGTTAGCAACTTGAGGTTACCAGTGGAGGAAGCCTACAAGAGAGGTC TGGTGGGCATTGAGTTCAAAGAGAAGCTCCTGTCTGCAGAACGAGCTGTCACTGGGTATAAT GATCCTGAAACAGGAAACATCATCTCTTTGTTCCAAGCCATGAATAAGGAACTCATCGAAAAG GGCCACGGTATTCGCTTATTAGA |
| 1400 | DSP | 2893829 | AAATGTCTGTTCAGGAGGCCTACAAGAAGGGCCTAATTGATTATGAAACCTTCAAAGAACTGT GTGAGCAGGAATGTGAATGGGAAGAAATAACCATCACGGGATCAGATGGCTCCACCAGGGT GGTCCTGGTAGATAGAAAGACAGGCAGTCAGTATGATATTCAAGATGCTATTGACAAGGGCC TTGTTGACAGGAAGTTCTTTGATCAGTACCGATCCGGCAGCCTCAGCCTCACTCAATTTGCTGA CATGATCTCCTTGAAAAATGGTGTCGGCACCAGCAGCAGCATGGGCAGTGGTGTCAGCGATG ATGTTTTTAGCAGCTCCCGACATGAATCAGTA |
| 1401 | DSP | 2893830 | AGATTTCCACCATATCCAGCGTCAGGAATTTAACCATAAGGAGCAGCTCTTT |
| 1402 | DSP | 2893831 | TACAGAAGGTATAGAGCGGGGCATCGTTGACAGCATCACGGGTCAGAGGCTTCTGGAGGCT CAGGCCTGCACAGGTGGCATCATCCACCCAACCACGGGCCAGAAGCTGTCACTT |
| 1403 | DSP | 2893832 | CCAGGGTGTGATTGACCAAGACATGGCCACCAGGCTGAAGCCTGCTCAGAAAGCCT |
| 1404 | DSP | 2893833 | AGAAAAATGGCTCCCGTATGAGGCTGGCCAGCGCTTCCTGGAGTTCCAGTACCTCACGGGAG |
| 1405 | DSP | 2893834 | TGGGAGGATAAGCACCGAAGAAGCCATCCGGAAGGGGTTCATAGATGGCCGCGCCGCACAG AGGCTGCAAGACACCAGCAGCTATGCCAAAATCCTGACCTG |
| 1406 | DSP | 2893835 | TAGAAGATATCACTGGGCTGCGCCTTC |
| 1407 | DSP | 2893836 | TTACAACATGTCTTCGGCTCCGGGTCCCGCTCCGGCTCCCGCTCGGGATCTCGCTCCGGATC TCGCTCCGGGTCCCGCAGTGGGTCCCGGAGAGGAAGCTTTGACGCCACAGGGAATTCTTCCT ACTCTTATTCCTACTCATTTAGCAGTAGTTCTATTGGGCACTA |
| 1408 | DSP | 2893837 | AGTTGGGAGTGGTTGCTATACCTTGACTTC |
| 1409 | DSP | 2893838 | TCCCGGTGCTTGCAGTAGAGTGATAGGACATTCTATGCTTACAGAAAATATAGCCATGATTGA AATCAAATAGTAAAGGCTGTTCTGGCTTTTTATCTTCTTAGCTCATCTTAAATAAGCAGTACAC TTGGATGCAGTGCGTCTGAAGTGCTAATCAGTTGTAACAATAGCACAAATCGAACTTAGGATT TGTTTCTTCTCTTCTGTGTTTCGATTTTTGATCAATTCTTTAATTTTGGAAGCCTATAATACAGTT TTCTATTCTTGGAGATAAAAATTAAATGGATCACTGATATTTTAGTCATTCTGCTTCTCATCTAA ATATTTCCATATTCTGTATTAGGAGAAAATTACCCTCCCAGCACCACCAGCCCCCCTCTCAACCCC CAACCCAAAACCAAGCATTTTGGAATGAGTCTCCTTTAGTTTCAGAGTGTGGATTGTATAACC CATATACTCTTCGATGTACTTGTTTGGTTTGGTATTAATTTGACTGTGCATGACAGCGGCAATC TTTT |
| 1410 | DSP | 2893839 | TTTATCATAGGTCTAAAAATATTTGT |
| 1411 | HIST1H2BF | 2899208 | TGCTAAGTCCGCTCCTGCTCCAAAAAAGGGC |
| 1412 | HIST1H2AE | 2899225 | GGCGGCAAAGCTCGGGCAAAAGCTAAAACGCGTTCTTCCAGGGCCGGTCTTCAGTTTCCAGT TGGCCGTGTGCACCGCTCCTCCGCAAAGGCAACTACTCCGAACGAGTCGGGGCCGGCGCTC CAGTGTACCTGGCAGCGGTGCTGGAATATCTGACGGCCGAGATCTTAGAGCTAGCTGGCAAC GCGGCTCGCGACAATAAGAAGACCCGCATCATCCCGCGCCACCTGCAGCTAGCCATCCGCAA CGACGAGGAGCTAAATAAGCTTCTAGGTCGCGTGACCATC |

TABLE 13-continued

Subtyping Target Sequences

| SEQ ID NO. | Gene | Affy Probeset ID | Sequence |
|---|---|---|---|
| 1413 | HLA-A | 2901162 | ACCCCCCCAAGACACATATGACCCA |
| 1414 | HLA-A | 2901181 | CCGTCATGGCGCCCCGAACCCTCCTCCTGCTACTCTCGGGGGCCCTGGCCCT |
| 1415 | HLA-A | 2901182 | CAGCGACGCCGCGAGCCAGAGGATGGAGCCGCGGGCGCCGTGGATAGAGCAGGAGGGGCCGGAGTATTGGGACCAGGAGACACGGAATGTGAAGGCCCAGTCACAGACTGAC |
| 1416 | HLA-A | 2901183 | TGGGGACCCTGCGCGGCTACTACAAC |
| 1417 | HLA-A | 2901184 | ACGGACGGGCCAGGTCGCCCACAGTCTCCGGGTCCGAGATCCACCCCGAAGCCGCGGGA |
| 1418 | HLA-A | 2901191 | TGTGCAGCATGAGGGTCTGCCCAAGCCC |
| 1419 | HLA-A | 2901193 | GGCCTGGTTCTCCTTGGAGCTGTGATCACTGGAGCTGTGGTCGCTGCCGTGATGTGGAGGAGGA |
| 1420 | HLA-A | 2901194 | AGATTTCTTGTCTCACTGAGGGTTCCAAGCCCCAGCTAGAAATGTGCCCTGTCTCATTACTGGGAAGCACCGTCCACAATCATGGGCCTACCCAGTCTGGGCCCTGTGTGCCAGCACTTACTCTTTTGTAAAGCACCTGTTAAAATGAAGGACAGATTTATCACCTTGATTACG |
| 1421 | HLA-A | 2901196 | GCAGTGACAGTGCCCAGGGCTCTGATGTGTCCCTCACAGCTTGTAAA |
| 1422 | HLA-A | 2901201 | TTACTTTCTCAAATTCTTGCCATGAGAGGTTGATGAGTTAATTA |
| 1423 | HLA-DRA | 2903191 | TGCCTCACTCCCGAGCTCTACTGACTCCCAACAG |
| 1424 | HLA-DRA | 2903195 | ATGTGATCATCCAGGCCGAGTTCTATCTGAATCCTGACCAATCAGGCGAGTTTATGTTTGACTTTGATGGTGATGAGATTTTCCATGTGGATATGGCAAAGAAGGAGACGGTCTGGCGGCTTGAAGAATTTGGACGATTTGCCAGCTTTGAGGCTCAAGGTGCATTGGCCAACATAGCTGTGGACAAAGCCAACCTGGAAATCATGACAAAGCGCTCCAACTATACTCCGATCA |
| 1425 | HLA-DRA | 2903196 | ACTGAGAGAGCCCAACGTCCTCATCTGTTTC |
| 1426 | HLA-DRA | 2903197 | GTCAATGTCACGTGGCTTCGAAATGGAAAACCTGTCAC |
| 1427 | HLA-DRA | 2903200 | CCCAGAGACTACAGAGAACGTGGTGTGTGCCCTGGGCCTGACTGTGGGTCTGGTGGGCATCATTATTGGGACCATCTTCATCATCAAGGGATTGCGCAAAAGCAATGCAGCAGAACGCAGGGGGCCT |
| 1428 | HLA-DRA | 2903202 | ATGGTGTTTCTTAGAGAGAAGATCACTGAAGAAACTTCTGCTTTAATGGCTTTACAAAGCTGGCAATATTACAATCCTTGACCTCAGTGAAAGCAGTCATCTTCAGCATTTTCCAGCCCTATAGCCA |
| 1429 | HLA-DRA | 2903203 | CACCATGCAATGCCTCTGGAATAAAACATACAGGAGTCTGTCTCT |
| 1430 | HLA-DRA | 2903204 | TGCCCCATGGGGCATCTCTTGTGTACTTATTGTTTAAGGTTTCCTCAAACTGTGA |
| 1431 | SERPINB1 | 2938983 | AATATATAGTTCATGTGGCGCTGCATGAAATCAAGAAGTGGGTGTCTTAGGATAAAAGATACCAAGAGTCTACAAAAATAACCATGTAGTAAGATAAACTGCTGAACAAAGGTTTTACTGTTAGCCACCTTCTCATGTGTTTTCTTTTCTCTTTTTCTTTTTCTTTCTTTCTTTTTTTTTTTTTGAGACAGAGTCTTGCTCTGTTACCCAGGCTGGAGTGCAGTGGCACGATCTCAGCTCACCGCAACCTCTGCCTCCTGGGTTCAAGTGATTCTCTTGCTTCAGCCTCCTGAGTAGCTGGGATTATAGGCATGCACCACTAGGCCTGGCTAATTTTTGTATTTTTAGTAGAGATGGGGTTTTTCCATGTTGGCCAGGCTGGTCCCGAACTCCTGACCTCAGGTGATCCGCGCACCTCAGCCTCCCAAAGTGCTGGGATTACAGGCATGAGCTACCATGCCTGGCCTTCTCATGTGTTTTCTGATTAAGGCTCTTGACTTCCAAGGCTGTGTGGGAGATGGGTGGGGCTCTTGGACTGATATAAAACTTTGTCAAATGTAGTTCTTTGAATGGAGCTTGAAACGCCACATATTCTTGCTCCCACAAGGATAGTGGGCATCATGA |
| 1432 | SERPINB1 | 2938984 | AGTATTCTGTTACAGACCTCTAGTTTTTAGACTCTTCAAT |
| 1433 | SERPINB1 | 2938985 | ACAGACACCCTGACTGTTGAAGGGAGGTTTAAAAACAGATATTCAATTGAAATGTAAGAGAGCACCCCAATTGAGAGCCCAGGTTACGAAGACAAGCTTGCCTCGCCTGACTTTTCTGTC |
| 1434 | SERPINB1 | 2938986 | TTAGAATTTTGGAAGCCACAAAATAG |
| 1435 | SERPINB1 | 2938987 | TGGCTGTTTACACCCATGAATTTTGGCATGGGTATCTATTTTCTTTTTTACATTGAAAAAAATCCAGTGGTTGCTTTTGAATGCATCAAGTAAAGAAGAAGAAAAGAATACATCCGATGCGTAGATTCTTGACCATGTAGTAATCTATAAAATTGCTATATCCTCCTGATAGCCATGGGAAAAC |
| 1436 | SERPINB1 | 2938988 | AAGAGACTGTAGCAATACAAAAATCAAGCTTAGTGCTTTATTACCTGAGTTTTTA |
| 1437 | SERPINB1 | 2938989 | GTAGCATCCTATTCTTGGGGAGATTTTCTT |
| 1438 | SERPINB1 | 2938990 | AAAATTTCACTGCCGACCATCCATTCCTTTTCTTTATTCGGCATAATTCCTCAG |

TABLE 13-continued

Subtyping Target Sequences

| SEQ ID NO. | Gene | Affy Probeset ID | Sequence |
|---|---|---|---|
| 1439 | SERPINB1 | 2938991 | CACAGCAGGCATCGCAACTTTCTGCATG |
| 1440 | SERPINB1 | 2938992 | CATGAGTGGACTAAACCTGAGAATCTCGATTTCATTGAAGTTAATGTCAGCTTGCCCAGGTTC AAACTGGAAGAGAGTTACACTCTCAACTCCGACCTCGCCCGCCTAGGTGTGCAGGATCTCTTT AACAGTAGCAAGGCTGATC |
| 1441 | SERPINB1 | 2938994 | TTTGCATATGGCTACATCGAGGACCTTAAGTGCCGTGTGCTGGAACTGCCTTACCAAGGCGAG GAGCTCAGCATGGTCATCCTGCTGCCGGATGACATTGAGGACGAGTCCA |
| 1442 | SERPINB1 | 2938996 | TTCGGGCATGGTTGATAACATGACCAAACTTGTGCTAGTAAATGCCATCTATTTCAAGGGAAA CTGGAAGGATAAATTCATGAAAGAAGCCACGACGAATGCACCATTCAGA |
| 1443 | SERPINB1 | 2938999 | GAAGATGCAAGGAAGACCATAAACCAGTGGGTCAAA |
| 1444 | SERPINB1 | 2939001 | CTTTCCATTTCAACACGGTTGAAGAGGTTCATTCAAGATTCCAGAGTCTGAATGCTGATATCAA CAAACGTGGAGCGTCTTATATTCTGAAACTTGCTAATAGATTATA |
| 1445 | SERPINB1 | 2939004 | GGACCAGAGGTAACACGGCAGCACAGCTGTCCAA |
| 1446 | SERPINB1 | 2939005 | AGCAAACACCCGCTTCGCCTTGGACCTGTTCCTGGCGTTGAGTGAGAACAATCCGGCTGGA |
| 1447 | SERPINB1 | 2939010 | GAGAGGCCAGGCTCCCTCGCTCAGCTTCCAGCCCGGCACCCCCCACCCCCCAGGCTCAGGCCC CTCAGACCCGCAGCTCCCTGCGCTCGCCCTCCCCGCCAGCTTCGCGCCCCCATCCCTTCCGGGC GCCCCGACGGAGACAGACGACCTCTGAT |
| 1448 | SERPINB1 | 2939011 | TTGCACTTAGGCGACCTCGGGAGCTCGGACTCCTACGCAGTCACCGGGAAGGGCCGCCGCCC CGCCCGCGGCTGCTGGCCCGGGTGACGCTTCCGCCTGCTATAAGAGCAGCGGCCCTCGGT |
| 1449 | IER3 | 2948631 | TGTGAACACAAATAAAATTGATTTACTGT |
| 1450 | IER3 | 2948632 | CTGGGACTTCCGAGGCAACTTGAACTCAGAACACTACAGCGGAGACGCCACCCGGTGCTTGA GGCGGGACCGAGGCGCACAGAGACCGAGGCGCATAGAGACCGAGGCACAGCCCAGCTGGG GCTAGGCCCGGTGGGAAGGAGAGCGTCGTTAATTTATTTCTTATTGCTCCTAATTAATATTTAT ATGTATTTATGTACGTCCTCCTAGGTGATGGAGATGTGTACGTAATATTTATTTTAACTTATGC AAGGGTGTGAGATGTTCCCCCTGCTGTAAATGCAGGTCTCTTGGTATTTATTGAGCTTTGTGG GACTGGTGGAAGCAGGACACCTGGAACTGCGGCAAAGTAGGAGAAGAAATGGGGAGGACT CGGGTGGGGAGGACGTCCCGGCTGGGATGAAGTCTGGTGGTGGGTCGTAAGTTTAGGAG GTGACTGCATCCTCCAGCATCTCAACTCCGTCTGTCTACTGTGTGAGACTTCGGCGGACCATTA GGAATG |
| 1451 | IER3 | 2948633 | CCCTTTAATCTGACTTCGGAGCCCTCGGACTACGCTCTGGACCTCAGCA |
| 1452 | IER3 | 2948634 | CTGCCTCCAGAGGACGCCCCTAACGCCGCATCCCTGGCGCCCA |
| 1453 | IER3 | 2948635 | CCGGCGCCAGCTGCCAGTCGAGGAACCGAACCCAGCCAAAAGGCTTCTCTTTCTGCTGCTCAC CATCGTCTTCTGCCAGATCCTGAT |
| 1454 | IER3 | 2948636 | ACTGGGGAACGACCCGACTCCAGAGGCCTCGAC |
| 1455 | IER3 | 2948637 | CTGCCACCCGACCATGACCATCCTGCAGGCCCCGACCCCGGCCCCCTCCACCATCCCGGGACC CCGGCGGGGCTCCGGTCCTGAGATCTTCACCTTCGACCCTCTCCCGGAGCCCGCAGCGGCCC TGCCGGGCGCCCCAGCGCCTCTCGCGGGCACCGAAAGCGCAGCCGCAGGGTTCTCTACCCTC GAGTG |
| 1456 | HLA-DRB1 | 2950021 | TGAAGTCCCAGCATTGATGGCAGCGCCTCA |
| 1457 | HLA-DRB1 | 2950023 | — |
| 1458 | HLA-DRB1 | 2950035 | TGATGGCAGCGCCTCATCTTCAACTTTTG |
| 1459 | HLA-DRB1 | 2950041 | — |
| 1460 | HLA-DRB1 | 2950042 | CTGCGGTGGTCTCCATAGGCCTGATCCAGAATGGA |
| 1461 | HLA-DRB1 | 2950043 | — |
| 1462 | HLA-DRB5 | 2950046 | — |
| 1463 | HLA-DRB1 | 2950052 | AATGTCCTCCCTTGTGGCTTCCTCAG |
| 1464 | HLA-DRB1 | 2950057 | — |
| 1465 | HLA-DRB5 | 2950067 | — |

TABLE 13-continued

Subtyping Target Sequences

| SEQ ID NO. | Gene | Affy Probeset ID | Sequence |
|---|---|---|---|
| 1466 | HLA-DRB1 | 2950068 | GGAGGGGTTCATAGTTCTCCCTGAGTGAGAC |
| 1467 | HLA-DRB5 | 2950095 | — |
| 1468 | GPR110 | 2955944 | GTGTGTTTCCCATGAACCATAGTGAGACATGCAAGAGTGAAGGTCAGCATGGGGCTCTTTTA<br>GGTCCTCTCTGATAGGGTTGTCCAAAGAGGTGGAGGGAACCCAGCATCAAGAAGTGGGAGG<br>TGAAGCCAGATTGTGGGATGAGGAAGGAGTCACAAATGACCACCTGGAATACAAAAAAATCT<br>ACACAAGCTAAAGATGAGAAGTCAGGGCTATGAGAATTTCTATGGGAGTTCTTGAATGCTCC<br>CTCTCTTATTACACACAATTACTATCCAGAGAACCCTGACACCATGTGAAGGCAGCCCTATCTC<br>ATAAGACAGATTTCTTTTTTTGGGGACCTTGGGGAAAGGGAGGCCAGAAACCTCCGTGTCCA<br>AGGTGGGGTGGAAGGAGAGGGAGAAATCTTAGCAAAAATGTCAACCAGCAAGGGAAGATG<br>TGCTAGCGCAAGTAGGCAACTCA |
| 1469 | GPR110 | 2955945 | AGGCACTTCCATCTGGTCCTAAACCCTGCAAACAAAAGTGTCAAGGCAGACCCTAGTGCAGAG<br>ATGAGGGCATGGGGGCTCAGAGAGGTAAAGTGACTTGCCAAAGATTGTGAAGCCAGTTAAG<br>GGAAATTGGGGATTTTTAGGACATTTGTCTCCCAGACCATTTCTACAGCCAATA |
| 1470 | GPR110 | 2955946 | TGTTGGAAATCGTGTCAGTTGTACCCTGACCATAAAATATGGTTTCTATTTTCATAAAACAGCA<br>TTATTCACATGGCATTTCCAATAATCTGGATTGAAGGAAGAAAATTTTATGAAATAGCTTTAG<br>ATAAATTAATAGGCCACGTTCATTTTCTTGTCAAAAAGTTACTGGTGGGGGATGGTGGGAA<br>AAAGTTATTAGTGCAAATTTCCTAGAGAAAAAACCATTTCTCTTTCAAATTTTCCAGTTGAATTT<br>TATGTTCGCTTTTGCTTCTTAGGTTC |
| 1471 | GPR110 | 2955947 | ATTATGCTCAGTATTCGATCGGGTTTTCTGATTTAGG |
| 1472 | GPR110 | 2955948 | TACTGGAGATTCCTCCGACAACATCATGCTAACTCAGTTTGTCTCAAATGA |
| 1473 | GPR110 | 2955949 | CTCATCAGATTTATCTGCCAAACCCAAATTCTCAAAGCCTTTCAACCCACTGCAAACAA |
| 1474 | GPR110 | 2955950 | TAGTCAGAGCACTGTTTTTCCTCCATTTTCCTCCATGGGTTTCTCTTCCAGTAACAAATGTGATC<br>CAAAGAAATGTAAGCATAGACATGAAAAGGGATAATGCCGCCTTTAAAACTGTTTTCTAGTTT<br>GTTGTTAGAAGTTATAAAAATACACAGGAACACAGCATTCACTTGAAAATAAATTTTTAGGCA<br>TTTTAAATAGATTAAAGCAGAAGAAAGAGTGAGAAAGTAACCATTCTAAATTCTTAAAAAGA<br>GAATAGCACCTATGAAAATGAAATAAAGAATCATGAATAACATCAGGAAGTCAGG |
| 1475 | GPR110 | 2955957 | TGCTTTGGAATACTCTTGGACAGTAAG |
| 1476 | GPR110 | 2955960 | TAGCCCTGTCCCTCTTGATTGCTGATGTCTGGTTTATTGTTGGTGCCACAGTGGACACCACGGT<br>GAACCCTTCTGGAGTCTGCACAGCTGCTGTGTTCTTTACACACTTCTTCTACCTCTCTCTTTGTTCT<br>TCTGGATGCTCATGCTTGGCATCCTGCTGGCTTACCGGATCATCCTCGTGTTCCATCACATGGC<br>CCAGCATTTGATGATGGCTGTTGGATTTTGCCTGGGTTATGGGTGCCCTCTCATTATATCTGTC<br>ATTACCATTGCTGTCACGCAACCTAGCAATACCTACAAAAGGAAAGATGTGTGTTGGCTTAAC<br>TGGTCCAATGGAAGCAAACCACTCCTGGCTTTTGTTGTCCCTGCACTGGCTATTG |
| 1477 | GPR110 | 2955961 | GGACCTGTGATATCCACGGTTATTCAAAACTATTCCATAAATGAAGTTTTCCTATTTTTTTCCAA<br>GATAGAGTCAAACCTGAGCCAGCCTCATTGTGTGTTTTGGGATTTCAGTCATTTGCAGTGGAA<br>CGATGCAGGCTGCCACCTAGTGAATGAAACTCAAGACATCGTGACGTGCCAATGTACTCACTT<br>GACCTCCTTCTCCATATTGATGTCACCTTTTGTCCCCTCTACAATCTTCCCCGTTGTAAAATGGA<br>TCACCTATG |
| 1478 | GPR110 | 2955962 | CTCAAAAGGGGTTACAGCTATCAGATTAAAATGTGTCCCCAAAATACATCTATTCCCATCAGA<br>GGCCGTGTGTTAATTGGGTCAGACCAATTCCAGAGATCCCTTCCAGAAACTATTATCAGCATG<br>GCCTCGTTGACTCTGGGGAACATTCTA |
| 1479 | GPR110 | 2955963 | AGCTGTGTCATCCTTCGTGCAAAATCTTTCTGTCATCATTCGGCAAAACCCATCAACCACAGTG<br>GGGAATCTGGCTTCGGTGGTGTCGATTCTGAGCAATATTTCATCTCTGTCACTGGCCAGCCAT<br>TTCAGGGTGTCCAATTCAAC |
| 1480 | GPR110 | 2955964 | AATGTTAGTTCTATATGGCCAAGACATCTGATTTAAATTTGATGAAACACAGCATGTCA |
| 1481 | GPR110 | 2955965 | ACTTGCCCTGGTCTTGAGTTTCAGAGTGGCAATATCCCAGTGAGCATGGCTAGGTGGAGGGT<br>AAGTATACCTACGTGCATCATTGGCCAGTATGCAAAGAGCAAGGATGACATCAGACCCTGGT<br>GAACCCGTGGAGTCGTGCATGAGTGGTAGCGTCTGGGCAGCAGAGTCTAGGTTGCAGCTCA<br>AAAGACAGAGTTGATAGTTTTGTCAGGCAGAGGTGTTGTGGAGGAGTGTATCATTGCTGAGG<br>AGGTCTATGATGGATGGTAGAGCAGCAACTAAGCTGGCCTCAGAAGTCCAGAAGACCTGGG<br>AATTAAAGAAGAGTGAAGGTGTGAGTCATAAGCCAGCAGGCTTAGTACAAGTAAGGATA<br>TATCTATACCAGAAATTAGGGCAAGGAGTGGGTCAGACAAAGGTGAACCATATAAAATGACT<br>GAACTGCAATGACCTTAAGGGGCATCTGGTTTACCAACCTCATTTTGCAGATCAGAAAACAA<br>AAGACCAAGGGCCAATAGTTCCTCTGGTAGCAATAGTTTTGAATTAGAAGCATGGTCACTTG<br>ATTCCTAGTCCAGTGCTGTATTAGTCTGTTCTCACATTGTTATAAAGAACTATTTGAGACTGGG<br>TAGTTTATAAAGAAAAGAGGTTTGACTCACAGTTATGCAGGATGTACAAAAGGCATATCTGG<br>GGAGGCCTCAGGAAACTTACAATCATGGTGGGAGGCGAAAGGGAAGTAAGCACATCCTTAT<br>ATGGTGACAGGAGAGAGAGAGAGAGAGAGAGAGAGAGAAAGAGAGAGATGGAGAGAGAATG |

TABLE 13-continued

Subtyping Target Sequences

| SEQ ID NO. | Gene | Affy Probeset ID | Sequence |
|---|---|---|---|
| | | | GGGGAGATGCTACACACTTTTAAACAACCAGATCTTGTGAGAACTGTATCATGAGACAGCACT TGGGGGATGGTGCTAAACCATTAGAAACCACCTCCATGATCCAATCATCTCCCACCAAGCCCC ACCTCCAACATTGGGAATTATAACTCGACATAAGATTTGGGTGGGGACACAGAGCCAAACCA CATCAGGTGCTATGCCCTCCACATGATGCTCTCTTAGGAAGGTTCAAGTATTAAGACAAGTAA GACAGAAAGAAGGAAATAAATATCTAGGAATCAGAAGAACTCAAGTCACAGAAAGAAGGA CCCCAAGACCAGTTCACAGATACTGTTCAGCAAGTAGATTTCCATATTGAGCAGAACTTCTATT CCAGCCAGAGACCTTGCTTCTGCTGCTGTGAGTAGAAAACCCCAGAATAGTATTCATCAGAGGA CTGTGGAATGTTTACTTCTCCCTTTGTGGATCTCAGTTTCCTCATCTGTAAACTGGGGAAGGGG ATTAGATTCTGGGGTTTCTTCTTGCTCTTGCCTTCGTTGCCTCAATTCTGGACATGAGCAATAG TTGAGACTAGTTCGCTCCAGGCAGATCCCAGGTGGCTTGAACAGAAAACAGCATTGTCAGTT GAGAAGAACAAGAAGGAAAATGGCGGGCACTTGGGCGCCTGAGTGGACTTAATGTTGAGTG GAAGGGGACTGCCTTCCTTTGCTGCTTTCCAAGTTAGCCTGGTGTAGTAAAAGTAGATGGGA GCCTCAAGAAAGAAGTAAAATTCCAAATCTAGGGCCGGGTGCA |
| 1482 | GPR110 | 2955966 | GGTCCAAGGATGATGAATATACCCTGCCCTGCAGCAGTGGCTACAGGGGAAACATCACAGCC AAGTGTGAGTCCTCTGGGTGGCAGGTCATCAGGGAGACTTGTGTGCTCTCTCTGCTTGAAGA ACTG |
| 1483 | GPR110 | 2955968 | AGCATCGTTGCTGGGTATGAAGTTGTTGGCTCCAGCAGTGCATCTGAACTGCTGTCAGCCATT GAACATGTTGCCGAGAAGGCTAAGACAGCCCTTCACAAGCTGTTTCCATTAGAAGACGGCTCT TTCAGAGTGTTCGGAAA |
| 1484 | GPR110 | 2956000 | CTGTGGAACCTGGTTTAACTTCACTAAATCAAACCTATAACAAGCAGGAAAA |
| 1485 | GPR110 | 2956001 | GCAACTACAGGAGATATGATGCCTCATAATTCGGAGCCAGAAGTGGGGCTTTGGGTGAGATA TCTTTGCACAGATAACATGTATACATCATAGTTCAAAACCCAGTAGTCATTGTTTACAGCA |
| 1486 | GPR110 | 2956002 | AATGTCACTCTTGTCGCCCAAGTTGGAGTG |
| 1487 | GPR110 | 2956003 | GAATTCAAGGTTTTGAGTCGGTTCAGGTCACCCAATT |
| 1488 | GPR110 | 2956004 | TTTGGGGCACTTTCAAAATTAATGAAAGGTTTACAAATGACCTTTTGAATTCATCTTCTGCTAT ATACTCCAAATATGCAAA |
| 1489 | GPR110 | 2956005 | GTACCTGTGAAGACAGCTACACCTGGTTTCCTCCCTCATGCCTTGATCCCCAGAACTGCTACCT TCACACGGCTGGAGCACTCCCAAGCTGTGAATGTCATCTCAACAACCTCAGCCAGAGTGTCAA TTTCTG |
| 1490 | GPR110 | 2956006 | ACTGCAACAGCCTGAATGGAGTCCTGCAG |
| 1491 | GPR110 | 2956007 | CTTCAGGTGACCTATAGAGATTCCAAGGAGAAAAGAGATTTGAGAAATTTTCTGAAGCTCTTG AAGCCTCCATTATTATGGTCACATGGGCTAATTAGAATTATCAGAGCAAAGGCTACCACAG |
| 1492 | GPR110 | 2956008 | AATGATGGCATCAAAACAAAAAAAGAACTCATTGTGAATAAGAAAAAACATC |
| 1493 | GPR110 | 2956009 | TCTTCACCTTCACTGACGGCCACGGTGGCTT |
| 1494 | GPR110 | 2956010 | ACTATGCACCCGACTGCTGCTGTTCA |
| 1495 | GPR110 | 2956016 | GCTCAGATACTGATACTTTCTTTCCAAACAGCATAAGAAGTGATTGAGCCACAAGTATACTGA AGGAAGGGCTCCCTCGAGTTCTGGTGTGAAGAGA |
| 1496 | TNFRSF21 | 2956054 | CTTATGCTAATATGCTCTGGGCTGGAGAAATGAAATCCTCAAGCCATCAGGATTTGCTATTTA AGTGGCTTGACAACTGGGCCACCAAAGAACTTGAACTTCACCTTTTAGGATTTGAGCTGTTCT GGAACACATTGCTGCACTTTGGAAAGTCAAAATCAAGTGCCAGTGGCGCCCTTTCCATAGAG AATTT |
| 1497 | TNFRSF21 | 2956055 | ATATGTCTTGTATAGTTCATATTCATGGCTGAAACTTGACCACACTATTGCTGATTGTATGGTT TTCAC |
| 1498 | TNFRSF21 | 2956056 | ACATAGGGATACTGCATTCTGGAAATTACTCAATTTAGTGGCAGGGTGGTTTTTAATTTTCTT CTGTTTCTGATTTTGTTGTTTGGGGTGTGTGTGTGTTTGTGTGTGTGTGTGTGTGT TGTGTGTGTGTTTAACAGAGAATATGGCCAGTGCTTGAGTTCTTTCTCCTTCTCTCTCTCTTTT TTTTTTAAATAACTCTTCTGGGAAGTTGGTTTATAAGCCTTTGCCAGGTGTAACTGTTGTGAA ATACCCACCACTAAAGTTTTTAAGTTCCATATTTTCTCCATTTTGCCTTCTTATGTATTTTCAAG ATTATTCTGTGCACTTTAAATTTACTTAACTTACCATAAATGCAGTGTGACTTTTCCCACACACT GGATTGTGAGGCTCTTA |
| 1499 | TNFRSF21 | 2956057 | GTGACTTGCAGCCTATCTTTGATGACATGCTCCACTTTCTAAATCCTGAGGAGCTGCGGGTGA TTGAAGAGATTCCCCAGGCTGAGGACAAACTAGACCGGCTATTCGAAATTATTGGAGTC |
| 1500 | TNFRSF21 | 2956058 | ACAAGGGCTTCTTCGTGGATGAGTCGGAGCCCCTTCTCCGCTGTGACTCTACATCCAGCGGCT CCTCCGCGCTGAGCAGGAACGGTTCCTTT |

TABLE 13-continued

Subtyping Target Sequences

| SEQ ID NO. | Gene | Affy Probeset ID | Sequence |
|---|---|---|---|
| 1501 | TNFRSF21 | 2956059 | CCCAACGCGAAACTTGAGAATTCCGCTCTCCTGACGGTGGAGCCTT |
| 1502 | TNFRSF21 | 2956064 | GATATCCTGAAGCTTGTAGCAGCCCAAGTGGGAAGCCAGTGGAAAGATATCTATCAGTTTCTT<br>TGCAATGCCAGTGAGAGGGAGGTTGCTGCTTTCTCCAATGGGTACACAGCCGACCACGAGCG<br>GGCCTACGCAGCTCTGCAGCACTGGACCATCCGGGGCCCCGAGGCCAGCCTCGCCCAGCTAA<br>TTAGCGCCCTGCGCCAGCACCGGAGAAACGATGTTG |
| 1503 | TNFRSF21 | 2956076 | GGGGACATCCTAGACAGAACCTACACAAGCATTTTGACATCAATGAGCATTTGCCCTGGATGA<br>TTGTGCTTTTCCTGCTGCTGGTGCTTGTGGTGATTGTGGTGTGCAGTATCCGGAAAAGCTCGA<br>GGACTCTGAAAAAGGGGCCCCGGCAGGATCCCAGTGCCATTGTGGAAAAGGCAGGGCTGAA<br>GAAATCCATGACTCCAACCCAGAACCGGGAGAAATGGATCTACTACTGCAATGGCCATG |
| 1504 | TNFRSF21 | 2956077 | AGAATCCAACTCTTCTGCCTCTGTTAGACCAAAGGTACTGAGTAGCATCCAG |
| 1505 | TNFRSF21 | 2956079 | TGGTGGTGATCAAGCCGGGGACCAAGGAGACAGACAACGTCTGTGGCACACTCCCGTCCTTC<br>TCCAGCTCCACCTCACCTTCCCCTGGCACAGCCATCTTTCCACGCCCTGAGCACATGGAAACCC<br>ATGAAGTCCCTTCCTC |
| 1506 | TNFRSF21 | 2956080 | GAAGGCCTCGAATCTCATTGGCACATACCGCCATGTTGACCGTGCCACCGGCCAGGTGCTAAC<br>CTGTGACAAGTGTCCAGCAGGAACCTATGTCTCTGAGCATTGTACCAACACAAGCCTGCGCGT<br>CTGCAGCAGTTGCCCTGTGGGGACCTTTACCAGGCATGAGAATGGCATAGAGAAATGCCATG<br>ACTGTAGTCAGCCATGCCCATGGCCAATGATTGAGAAATTACCTTGTGCTGCCTTGACTGACC<br>GAGAATGCACTTGCC |
| 1507 | TNFRSF21 | 2956094 | CGAGCCACAGCCACGATGATCGCGGGCTCCCTTCTCC |
| 1508 | TNFRSF21 | 2956095 | TGCACATGGGGTGTTGGAGGTAGATGGGCTCCCGGCCCGGGAGGCGGCGGTGGATGCGGC<br>GCTGGGCAGAAGCAGCCGCCGATTCCAGCTGCCCCGCGCGCCCCGGGCGCCCCTGCGAGTCC<br>CCGGTTCA |
| 1509 | TNFRSF21 | 2956096 | GTGCTGAGCGCCCCTAGAGCCTCCCTTGC |
| 1510 | TNFRSF21 | 2956097 | CTGGAAGCTTCGCTATGGGAAGTCGTTCCTTTGCTCTCTCGCGCCCAGTCCTCCTCCCTGGTTC<br>TCCTCAGCCGCTGTCGGAGGAGAGC |
| 1511 | CRISP3 | 2956567 | ACGCATTACACACCGAGTAGGGCTATGTAGAGAGGAGTCAGATTATCTACTTAGATTTGGCAT<br>CTACTTAGATTTAACATATACTAGCTGAGAAATTGTAGGCATGTTTGATACACATTTGATTTCA<br>AATGTTTTTCTTCTGGATCTGCTTTTTATTTTACAAAATATTTTTCATACAAATGTTAAAAAG<br>AAACAAAATCTATAACAACAACTTTGGATTTTATATATAAACTTTGTGATTTAAATTTACTGAA<br>TTTAATTAGGGTGAAAATTTTGAAAGTTGTATTCTCATATGACTAAGTTCACTAAAACCCTGGA<br>TTGAAAGTGAAAATTATGTTCCTAGAACAAAATGTACAAAAAGAACAATATAATTTTCACATG<br>AACCCTTGGCTGTAGTTGCCTTTCCTAGCTCCACTCTAAGGCTAAGCATCTTCAAAGACGTTTT<br>CCCATATGCTGTCTTAATTCTTTTCACTCATTCACCCTTCTTCCCAATCATCTGGCTGGCATCCTC<br>ACAATTGAGTTGAAGCTGTTCCTCCTAAAACAATCCTGACTTTTATTTTGCCAAAATCAATACA<br>ATCCTTTGAATTTTTTATCTGCATAAATTTTACAGTAGAATATGATCAAACCTTCATTTTTAAAC<br>CTCTCTTCTCTTTGACAAAACTTCCTTAAAAAGAATACAAGATAATATAGGTAAATACCCTCC<br>ACTCAAGGAGGTAGAACTCAGTC |
| 1512 | CRISP3 | 2956568 | CAGTTGCAAGGCCTCCTGCAATTGTTCAAACAGCA |
| 1513 | CRISP3 | 2956571 | TGAACAAGGAGCACCTTGTGCCAGTTGCCCAGATAACTGTGACGATGGACTATGCA |
| 1514 | CRISP3 | 2956574 | GCAGCAAATGCCCAAAAGTGGGCAAACCAGTGCAATTACAGACACAGTAACCCAAAGGATCG<br>AATGACA |
| 1515 | CRISP3 | 2956575 | ACCCAAACACAAGTGCAAAGGGAGATTGTGAATAAGCACAATGAACTGAGGAGAGCAGTAT<br>CTCCCCCTGC |
| 1516 | CRISP3 | 2956576 | CCAGTGCTGTTGTTCCTGGTTGCTG |
| 1517 | CRISP3 | 2956577 | GCAGATCCCTGTTCCACCGGTTTTGT |
| 1518 | CRISP3 | 2956578 | CTTCATCCTGCTCTGGAAACCACTG |
| 1519 | GSTM2 | 2969579 | AGACCTGTGTTCACAAAGATGGCTGTCTGGGGCAACAAGTAG |
| 1520 | PERP | 2976366 | AGCCAGACATGCTAAGTGGCACTTACTGCTGATTGTAACAAAGAAGTAATATATCAAGGTCTT<br>TCCATGTTCACACAAGGTAGCTTGTGTGTAATAACTTAGCTTCAAAACCATAGACTGCAGAAC<br>TCACAAGTTCAACAGCCTTTCCTTTTTTAAGGAAATGAAAACAATGGAAAATATAGTCATCATA<br>ACTTAATTCGGTTTATTTTTTTTTTCTGTAAACTCCCCCTGAAAGACATTCCTATTAATACAGTA<br>AATGTGAACACTGACTTGTTTTTATAAGCACATCTGAAAGGGCATATTTGAGTCTCATCCCAAC<br>TTTGGTCCTTGCTATCTGTGCAGGCTTGGGCAGGTCATCTCCCTGCTGGTCTCAATATCCTCAC<br>CTGTAAAATGATTGTAAATGATCCCCCTACCTTCAAGATTCTCTGATTGATAGAATTTTTTCTTT<br>AATTAAAAAATTTTAAATATTCCTTGAGTTGGAAGCACTGATCAATAAGTGGATTGCTTAGGG |

TABLE 13-continued

Subtyping Target Sequences

| SEQ ID NO. | Gene | Affy Probeset ID | Sequence |
|---|---|---|---|
| | | | AGGTTGGAACGAATAGATTCAGTCCCAACTTCCTCTTTTAAATTCCCTCTTCCTCACTCTTCCTG<br>CAACACTTATTTTTACAGTTGAGTTTTAAAAATAAGTAATATATAAAATAATTTCTGTAGTGTG<br>GTTTCAGATTTAAAAATTCCTGCAGACAGGCTGGGCTTGCAACCCCATCAGTCGATGGTCAGA<br>GCCCTTTGCTTTTTGAGACCATTTTTAGGTGAGCTTGGCTTGCCTGGATACAGTGTGCAGTGC<br>ATTCTTCCTGAATTTTGCAATTCTGGTATCTGGGTGTATTTTCTAGGTGTGTCAGGGTGAGTGT<br>AATCCACCTAGGGTGTGGAAAAAGCCAAGAAAGGGAAATTAAAAGAGGTTCCTATCCAGTCA<br>TGTTAATGATCTTCCACTTGTACTATCCTGTGCTTCGTTGTTAACC |
| 1521 | PERP | 2976367 | TGTGCAGTGTAGCTGAAGCCTCCTCCTTGTGCTGGGGTCCCCTTCCATTCAGGTGGTGGGGTA<br>GCAGTCTCTCTATTTTCCCCTTGCCCTCCTTCCCATTTTATCATTTGTTATTTTTTTCCCACCATA<br>AGTCATATGTTACTTCCACTATGGTGTATGTCATTGTGAGGATGGGTGCAGAGAGGCTGGGT<br>GGGAGAACGGAAATATATCTCCCTAGGGCTACTGTTGGCCAGCTAGTCCTTGGCAGTGAATTTT |
| 1522 | PERP | 2976368 | TATATATGATGCATCGGATAGGTCATTATGATTTTTTACCATTTCGACTTACA |
| 1523 | PERP | 2976369 | GCTAAGGCTTCATGTTGACTCGATATGTCATCTAGGAAAGTACTATTTCATGGTCCAAACCTGT<br>TGCCATAGTTGGTAAGGCTTTCCTTTAAGTGTGAAATATTTAGATGAAATTTTCTCTTTTAAAG<br>TTCTTTATAGGGTTAGGGTGTGGGAAAATGCTATATTAATAAATCTGTAGTGTTTTGTGTTTAT<br>ATGTTCAGAACCAGAGTAGACTGGATTGAAAGATGGACTGGGTCTAATTTATCATGACTGAT<br>AGATCTGGTTAAGTTGTGTAGTAAAGCATTAGGAGGGTCATTCTTGTCA |
| 1524 | PERP | 2976370 | TTTCTCCAGGCGACTTTGAACCCATTT |
| 1525 | PERP | 2976371 | TTCATGCCAACCCTGCTGTCACTTAC |
| 1526 | PERP | 2976378 | TCATCATCCTGGTGATCTGTTTCATCCTCTCCTTCTTCGCCCTCTGTGGACCCCAGATGCTGTC<br>TTCCTGAGAGTGATTGGAGGTCTCC |
| 1527 | PERP | 2976389 | CAGCGGGTCCTACGAGGAGGGCTGTC |
| 1528 | PERP | 2976390 | CACGGCCAGACGTCCTCGCTGTGGTGGAAATG |
| 1529 | PERP | 2976393 | CCGCGGCCTCTTCGCTTTTGTGGCGGCGCCCGCGCTCGCAGGCCACTCTCTGCTGTCGCCCGT<br>CCCGCGCGCTCCTCCGACCCGCT |
| 1530 | THBS2 | 2985810 | GTGTTGTGGGTCAACCGTACAATGGTGTGGGAGTGACGATGATGTGAGTATTTAGAATGTA<br>CCATATTTTTTGTAAATTATTTATGTTTTTCTAAACAAATTTATCGTATAGGTTGATGAAACGTC<br>ATGTGTTTTGCCAAAGACTGTAAATATTTATTTATGTGTTCACATGGTCAAAATTTCACCACTG<br>AAACCCTGCACTTAGCTAGAACCTCATTTTTA |
| 1531 | THBS2 | 2985811 | TCACGATGAAGCATGCTAGAAGCTGTAACAGAATACATAGAGAATAATGAGGAGTTTATGAT<br>GGAACCTTAAATATATAATGTTGCCAGCGATTTTAGTTCAATATTGTTACTGTTATCTATCTGC<br>TGTATATGGAATTCTTTTAATTCAAACGCTGAAAAGAATCAGCATTTAGTCTTGCCAGGCACAC<br>CCAATAATCAGTCATGTGTAATATGCACAAGTTTGTTTTTGTTTTTGTTTTTTTTGTTGGTTGGT<br>TTGTTTTTTGCTTTAAGTTGCATGATCTTTCTGCAGGAAATAGTCACTCATCCCACTCCACATA<br>AGGGGTTTAGTAAGAGAAGTCTGTCTGTCTGATGATGGATAGGGGGCAAATCTTTTTCCCCTT<br>TCTGTTAATAGTCATCACATTTCTATGCCAAACAGGAACAATCCATAACTTTAGTCTTAATGTA<br>CACATTGCATTTTGATAAAATTAATTTTGTTGTTTCCTTTGAGGTTGATCGTTGTTGTTGTTT<br>TGCTGCACTTTTTACTTTTTTGCGTGTGGAGCTGTATTCCCGAGACCAACG |
| 1532 | THBS2 | 2985812 | CATCCTTGCAAATGGGTGTGACGCGGTTCCAGATGTGGATTTGGCAAAACCTCATTTAAGTAA<br>AAGGTTAGCAGAGCAAAGTGCGGTGCTTTAGCTGCTGCTTGTGCCGCTGTGGCGTCGGGGAG<br>GCTCCTGCCTGAGCTTCCTTCCCCAGCTTTGCTGCCTGAGAGGAACCAGAGCAGACGCACAGG<br>CCGGAAAAGGCGCATCTAACGCGTATCTAGGCTTTGGTAACTGCGGACAAGTTGCTTTTACCTG |
| 1533 | THBS2 | 2985813 | TGGGCATGCCATTACATTGCTTTTTCTTGTTTGTTTAAAAAGAATGACGTTTACATATAAAATG<br>TAATTACTTATTGTATTTATGTGTATATGGAGTTGAAGGGAATACTGTGCATAAGCCATTATGA<br>TAAATTAAGCATGAAAAATATTGCTGAACTACTTTTGGTGCTTAAAGTTGTCACTATTCTTGAA<br>TTAGAGTTGCTCTA |
| 1534 | THBS2 | 2985814 | TCCTGTCCCTTGACCTTAACTCTGATGGTTCTTCAC |
| 1535 | THBS2 | 2985815 | ATGCCATGGTCCCTAGACACCTCAGTTCATTGTGG |
| 1536 | THBS2 | 2985816 | CAGACTCAGGACCTATCTATGACCAAACCTACGCTGGCGGGCGGCTGGGTCTATTTGTCTTCT<br>CTCAAGAAATGGTCTATTTCTCAGACCTCAAGTACGAATGCAGAG |
| 1537 | THBS2 | 2985817 | TGCGAACCTTATGGCACGACCCCAGGAACATTGGCTGGAAGGACTACACGGCCTATAGGTGG<br>CACCTGACTCACAGGCCCAAGACTGGCTACATC |
| 1538 | THBS2 | 2985818 | TTCAGTGGCACATTCTACGTAAACACTGACCGGGACGACGACTATGCCGGCTTCGTCTTTGGT<br>TACCAGTCAAGCAGCCGCTTC |

TABLE 13-continued

Subtyping Target Sequences

| SEQ ID NO. | Gene | Affy Probeset ID | Sequence |
|---|---|---|---|
| 1539 | THBS2 | 2985819 | TGATGGACGGGGTGATATTTGTAAAGATGATTTTGACAATGACAACATCCCAGATATTGATGA TGTGTGTCCTGAAAACAATGCCATCAGTGAGACAGACTTCAGGAACTTCCAGATGGTCCCCTT GGATCCCAAAGGGACCACCCAAATTGATCCCAACTGGGTCATTCGCCATCAAGGCAAGGAGC TGGTTCAGACAGCCAACTCGGACC |
| 1540 | THBS2 | 2985824 | TGTCTTCAATGAACGAGACAATTGTCCCTACGTCTACAACACTGACCAGAGGGACACGGATGG |
| 1541 | THBS2 | 2985825 | TTCAATCCCCGCCAGGCTGACTATGACAAGGATGAGGTTGGGGACCGCTGTGACAACTGCCC TTACGTGCACAACCCTGCCCAGATCGACACAGACAACAATGGAGAGGGTGACGCCTGCTCCG TGGACATTGATGG |
| 1542 | THBS2 | 2985827 | ACAAGGACGGGATTGGCGATGCCTGTGATGAT |
| 1543 | THBS2 | 2985830 | TGAGCCCGAAAACCCATGCAAGGACAAGACACACAACTGCCACAAGCACGCGGAGTGCATCT ACCTGGGCCACTTCAGCGACCCCATGTACAAGTGCGAGTGCCAGACAGGCTACGCGGGCGAC GGGCTCATCTGCGGGGAGGACTCGGACCTGGACGGCTGGCCCAACCTCAATCTG |
| 1544 | THBS2 | 2985833 | TCCACCAGCAAGGTGCCTCGCTGTGTCAACACTCAGCCTGGCTTCCACTGCCTGCCCTGCCCG CCCCGATACAGAGGGAACCAGCCCGTCGGGGTCGGCCTGGAAGCAG |
| 1545 | THBS2 | 2985836 | TGAAACCCGGGCTTCCATTCTGATGAAAGCACAAACGCTTTGGGAAACTAGATGAAAAACA CAGAAAAGAAAAATCAATTTTAGTTGCACACGCAAAGATAACTACTTTTAACATCTGTGTTTCA GTCCTCCTGTATTTCTAATGTAAAAACAAAAAAGATGCCAGGTGGCGTGGCCT |
| 1546 | THBS2 | 2985837 | GGTCCCCGTGGTCGGCCTGCACTGTCACCTGTGCCGGTGGGATCGGGAGCGCACCCGGGTC TGCAACAGCCCTGAGCCTCAGTACGGAGGGAAGGCCTGCGTGGGGATGTGCAGGAGCGTC AGATGTGCAACAAGA |
| 1547 | THBS2 | 2985838 | TCTGTGACCTGTGGAGTTGGCAATATCACACGCATCCGTCTCTGCAACTCCCCAGTGCCCCAG ATGGGGGGCAAGAATTGCAAA |
| 1548 | THBS2 | 2985839 | TCCGGCAGGACGGCGGCTGGAGCCACTGGT |
| 1549 | THBS2 | 2985840 | AAATACCCCTCTAGGCGGCACAGCCTGATCTCTCT |
| 1550 | THBS2 | 2985841 | TGGACCCAGTGCTCCGTGACGTGTGGCTCTGGGACCCAGCAGAGAGGCCGGTCCTGTGACGT CACCAGCAACACCTGCTTGGGGCCCTCCATCCAGACACGGGCTTGCAGTCTGAGCAAGTGTG ACACC |
| 1551 | THBS2 | 2985844 | AAACCATTTGCCACCAAATCACCTGCCCGCCTGCAACCTGCGCCAGTCCATCCTTTGTGGAAG GCGAATGCTGCCCTTCCTGCC |
| 1552 | THBS2 | 2985846 | TCATTGGTGGCCCTCCTAAGACAAGGAACATGTCAGCTTGCTGGCAGGATGGCCGGTTCTTTG CGGAAAATGAAACGTGGGTGGTGGACAGCTGCACCACGTGTACCTGCA |
| 1553 | THBS2 | 2985849 | TCCGCATGTCACCACCGAGTACGTGGGCCCCAGCTCGGAGAGGAGGCCCGAGGTGTGCGAA CGCTCGTGCGAGGAGCTGGGAAACATGGTCCAGGAGCTCTCGGGGCTCCACGTCCTCGTGAA CCAGCTCAGCGAGAACCTCAAGA |
| 1554 | THBS2 | 2985854 | AAATGCATTTTATATACTGGCTTGGATGGATTTCTATTGTGACATGGTGTATGTGTGTGTGTGT ATGTGTGTGCATTCATGCTTGTA |
| 1555 | THBS2 | 2985855 | GCTTCAGAACGTCCACCTAGTGTTTGAAAACTCTGTGGAAGATATTCTAAGCAAGAAGGGTTG CCAGCAAGGCCA |
| 1556 | THBS2 | 2985856 | CGCTTCGTGCGCTTTGACTACATCCCACCGGTGAACGCAGATGACCTCAGCAAGATCACCAAG ATCATGCGGCAGAAGGAGGGCTTCTTCCTCACGGCCCAGCTCAAGCAGGACGGCAAGTCCAG GGGCACGCTGTTGGCTCTGGAGGGCCCCGGTCTCTCCCAGAGGCAGTTCGAGATCGTCTCCA ACGGCCCCGCGGACACGCTGGATCTCACCTACTGGATTGA |
| 1557 | THBS2 | 2985857 | TGGTCTGGAGGCTGGTCCTGCTGGCTCTGTGGGTGTGGCCCAGCACGCAAG |
| 1558 | THBS2 | 2985860 | CCCTGGTGAAGTTTCATTTGCCGAATTCATCTCTCATGACAACCCGATGAGGTGGGCATTTTAC ATGACGCTACGTTTCATTCTACGGATGAGGA |
| 1559 | THBS2 | 2985863 | CCTGCACAGGAGAAGCGGCATATAAAGCCGCGCTGCCCGGGAGCCGCTCGGCCACGTCCACC GGAGCATCCTGCACTGCAGGGCCGGTCTCTCGCTCCAGCAGAGCCTGCGCCTTTCTGACTCGG TCCGAACACTGAAACCAGTCATCACTGCATCTTTTTGGCAA |
| 1560 | THBS2 | 2985864 | GAGACGGCATCCAGTACAGAGGGGCTGGACTTGGACCCCTGCAGCAG |
| 1561 | AHR | 2991234 | TCCCGTCGACGCTCTGTTCCGAGAGCGTGCCCCGGACCGCCAGCTCAGAACAGGGGCAGCCG TGTAGCCGAACGGAAGCTGGGAGCAGCCGGGACTGGTGGCCCGCGCCCGAGCTCCGCAGGC GGGAAGCACCCTGGATTTAGGAAGTCCCGGGAGCAGCGCGGCGGCACCTCCCTCACCCAAG |

TABLE 13-continued

Subtyping Target Sequences

| SEQ ID NO. | Gene | Affy Probeset ID | Sequence |
|---|---|---|---|
| | | | GGGCCGCGGCGACGGTCACGGGGCGCGGCGCCACCGTGAGCGACCCAGGCCAGGATTCTAA
ATAGACGGCCCAGGCTCCTCCTCCGCCCGGGCCGCCTCACCTGCGGGCATTGCCGCGCCGCT
CCGCCGGTGTAGACGGCACCTGCGCCGCCTTGCTCGCGGGTCTCCGCCCCTCGCCCACCCTCA
CTGCGCCAGGCCCAGGCAGCTCACCTGTACTGGCGCGGGCTGCGGAAGCCTGCGTGAGCCG
AGGCGTTGAGGCGCGGCGCCCACGCCACTGTCCCGAGAGGACGCAGGTGGAGCGGGCGCG
GCTTCGCGGAACCCGGCGCCGGCCGCCGCAGTGGTCCCAGCCTACACCGGGT |
| 1562 | AHR | 2991238 | GTCAAATCCTTCCAAGCGGCATAGAGACCGACTTAATACAGAGTTGGACCGTTTGGCTAGCCT
GCTGCCTTTCCCACAAGATGTTATTAATAAGTTGGACAAACTTTCAGTTCTTAGGCTCAGCGTC
AGTTA |
| 1563 | AHR | 2991240 | AGGATAACTGTAGAGCAGCAAATTTCAGAGAAGGCCTGAACTTACAAGAA |
| 1564 | AHR | 2991244 | TCTGAATGGCTTTGTATTAGTTGTCACTACAGATGCTTTGGTCTTTTATGCTTCTTCTACTATAC
AAGATTATCTAGGGTTTCAGCA |
| 1565 | AHR | 2991245 | ATCAGTCCTTTTGTTGTATTCCTTGTATC |
| 1566 | AHR | 2991246 | ACCGAAGACCGAGCTGAATTTCAGCGTCAGCTACACTGGGCATTAAATCCTTCTCAGTGTACA
GAGTCTGGACAAGGAATTG |
| 1567 | AHR | 2991247 | AGACAGTAGTCTGTTATAACCCAGACCAGATTCCTCCAGAAAACTCTCCTTTAATGGAGAGGT
GCTTCATATGTCGTCTAAGGTGTCTGCTGGATAA |
| 1568 | AHR | 2991249 | TTTAGGATATACTGAAGCAGAGCTGTGCACGAGAGGCTCAGGTTATCAGTTTATTCATGCAGC
TGATATGCTTTATTGTGCCGAGTC |
| 1569 | AHR | 2991252 | AACCGATGGACTTGGGTCCAGTCTAATGCACGCCTGCTTTATAAAAATGGAAGACCAGATTAT
ATCATTGTAACTCAGAGACCACTA |
| 1570 | AHR | 2991253 | ATAAGTCCTCTTATGTGAAAGCATAAAAATAATTCAAGCAGACTTTAGTCTGTAAATAAAAATT
GAAAAGTTTAATTCATCTAGAAAGAAGAGCACAGGTGAGAGACATTGAGAAGATAGAATTG
ACGAACTTGATTGAGAGCTACATGTGCAGAGCTATAGAAAGAATAATAAAACTCTAGGGTTTT
ATCTTGGGCATATGAAAGACACA |
| 1571 | AHR | 2991254 | AGGAAGGAACAGAGCATTTACGAAAACGAAATACGAAGTTGCCTTTTATGTTTACCACTGGA
GAAGCTGTGTTGTATGAGGCAACCAACCCTTTTCCTG |
| 1572 | AHR | 2991255 | TGCACCGATGGGAAATGATACTATCCTGAAACATGAGCAAATTGACCAGCCTCAGGATGTGA
ACTCATTTGCTGGAGGTCACCCAGGGCTCTTTCAAGATAGTAAAAACAGTGACTTGTACAGCA
TAATGAAAAACCTAGGCATTGATTTTGAAGCATCAGACACATGCAGAATGAAAAATTTTTCA
GAAATGATTTTTCTGGTGAGGTTGACTTCAGAGACATTGACTTAACGGATGAAATCCTGACGT
ATGTCCAAGATTCTTTAAGTAAGTCTCCCTTCATACCTTCAGATTATCAACAGCAACAGTCCTT
GGCTCTGAACTCAAGCTGTATGGTA |
| 1573 | AHR | 2991256 | TGAAGCACATGCAAGTTAATGGCATGTTTGAAAATTGGAACTCTAACCAATTCGTGCCTTTCA
ATTG |
| 1574 | AHR | 2991257 | TGTACAGAGCTGGACTACCCTATGGGGAGTTTTGAACCATCCCCATACCCCACTACTTCTAGTT
TAGAAGATTTTGTCACTTGTTTACAACTTCCTGAAAACCAAAAGCATGGATTAAATCCACAGTC
AGCCATAATAACTCCTCAGACATGTTATGCTGGGGCCGTGTCGATGTATCAGTGCCAGCCAGA
ACCTCAGCACACCCACGTGGGTCAGATGCAGTACAATCCAGTA |
| 1575 | AHR | 2991262 | GAAACATATCCAGCTGAATTAAATAACATAAATAACACTCAGACTACCACACATCTTCAGCCA
CTTCATCATCCGTCAGA |
| 1576 | AHR | 2991263 | AAACTGTCACTGTTGGACGTCAGCAAGTTCACATGGAGGCATTGATGCATGCTATTCACAATT
ATTCCAAACCAAATTTTAATTTTTGCTTTTAGAAAAGGGAGTTTAAAAATGGTATCAAAATTAC
ATATACTACAGTCAAGATAGAAAGGGTGCTGCCACGGAGTGGTGAGGTACCGTCTACATTTC
ACATTATTCTGGGCACCACAAAATATACAAAACTTTATCAGGGAAACTAAGATTCTTTTAAATT
AGAAAATATTCTCTATTTGAATTATTTCTGTCACAGTAAAAATAAAACTTTGAGTTTTGAGC
TACTGGATTCTTATTAGTTCCCCAAATACAAAGTTAGAGAACTAAACTAGTTTTTCCTATCATG
TTAACCTCTGCTTTTATCTCAGATGTTAAATAAATGGTTTGGTGCTTTTTATAAAAAGATAATC
TCAGTGCTTTCCTCCTTCACTGTTTCATCTAAGTGCCTCACATT |
| 1577 | AHR | 2991264 | GTTGCTATGTGCCTTATGTTGAAAAAATTTAAAAGTAAAATGTCTTTCCAAATTATTTCTTAATT
ATTATAAAAATATTAAGACAATAGCACTTAAATTCCTCAACAGTGTTTTCAGAAGAAATAAATA
TACCACTCTTTACCTTTATTGATATCTCCATGATGATAGTTGAATGTTGCAATGTGAAAAATCT
GCTGTTAACTGCAACCTTGTTTATTAAATTGCAAGAAGCTTTATTTCTAGCTTTTTAATTAAGCA
AAGCACCCATTTCAATGTGTATAAATTGTCTTTAAAAACTGTTTTAGACCTATAATCCTTGATA
ATATATTGTGTTGACTTTATAATTTCGCTTCTTAGAACAGTGGAAACTATGTGTTTTTCTCATA
TTTGAGGAGTGTTAAGATTGCAGATAGCAAGGTTTGGTGCAAAGTATTGTAATGAGTGAATT
GAATGGTGCATTGTATAGATATAATGAACAAAATTATTTGTAAGATATTTGCAGTTTTTCATTT
TAAAAAGTCCATACCTTATATATGCACTTAATTTGTTGGGGCTTTACATACTTTATCAATGTGTC |

TABLE 13-continued

Subtyping Target Sequences

| SEQ ID NO. | Gene | Affy Probeset ID | Sequence |
| --- | --- | --- | --- |
| | | | TTTCTAAGAAATCAAGTAATGAATCCAACTGCTTAAAGTTGGTATTAATAAAAAGACAACCAC ATAGTTCGTTTACCTTCAAACTTTAGGTTTTTTTAATGATATACTGATCTTCATTACCAATAGGC AAA |
| 1578 | AHR | 2991265 | TATGAGAGCTGAAGAGCTTAGACACATTTTGCATGTATTATTTGAAAATCTGATGGAATCCCA AACTGAG |
| 1579 | AHR | 2991266 | GAATAGCCTGAACCTGGGAATCGGAG |
| 1580 | AHR | 2991267 | ATGGCTTCGGACAAAATATCTCTGAGTTCTGTGTATTTTCAGTCAAAACTTTAAACCTGTAGAA TCAATTTAAGTGTTGGAAAAAATTTGTCTGAAACATTTCATAATTTGTTTCCAGCATGAGGTAT CTAAGGATTTAGACCAGAGGTCTAGATTAATACTCTATTTTTACATTTAAACCTTTTATTATAAG TCTTACATAAACCATTTTTGTTACTCTCTTCCACATGTTACTGG |
| 1581 | AHR | 2991268 | AACTAAAATGTATCTAAGAATAATAAAATCACGTTAA |
| 1582 | AHR | 2991269 | CGTTTGTCTGTATTGTTAAGTGCCAAACAAAGGATACTTAGTGCACTGCTACATTGTGGGATTT ATTTCTAGATGATGTGCACATCTAAGGATATGGATGTGTCTAATTTAGTCTTTTCCTGTACCAG GTTTTTCTTACAATACCTGAAGACTTACCAGTATTCTAGTGTATTATGAAGCTTTCAACATTACT ATGCACA |
| 1583 | COL1A2 | 3013077 | TATGCAGACAACGAGTCAGAGTTTCCCCTTGAAAGCCTCAAAAGTGTCCACGTCCTCAAAAAG AATGGAACCAATTTAAGAAGCCAGCCCCGTGGCCACGTCCCTTCCCCCATTCGCTCCCTCCTCT GCGCCCCCGCAGGCTCCTCCCAGCTGTGGCTGCCCGGGCCCCAGCCCCAGCCCTCCCATTGG TGGAGGCCCTTTTGGAGGCACCCTAGGGCCAGGGAAACTTTTGCCGTATAAATAGGGCAGAT CCGGGCTTTATTATTTTAGCACCACGGCAGCAGG |
| 1584 | COL1A2 | 3013078 | GTGATACCTCCGCCGGTGACCCAGGGGCTCTGCGACACAAGGAGTCTGCATGTCTAAGTGCT AGA |
| 1585 | COL1A2 | 3013083 | GGCCCAGCCGGAGATAGAGGACCACGTGGA |
| 1586 | COL1A2 | 3013084 | AGATGGTCCCACAGGCCCTCCTGGTC |
| 1587 | COL1A2 | 3013091 | GGCTTAATGGGACCTAGAGGCCCACCTGGT |
| 1588 | COL1A2 | 3013092 | GCCCTCAAGGTTTCCAAGGACCTGCTG |
| 1589 | COL1A2 | 3013093 | GTGAGCCTGGTGAACCTGGTCAAAC |
| 1590 | COL1A2 | 3013098 | TCTGGATGGATTGAAGGGACAGCCCGGTGCTCC |
| 1591 | COL1A2 | 3013102 | CCTGGTGAGAGAGGACGTGTTGGTG |
| 1592 | COL1A2 | 3013103 | GGTGCCCGTGGCAGTGATGGAAGTG |
| 1593 | COL1A2 | 3013104 | GGTCCCATTGGGTCTGCTGGCCCTCCAGGC |
| 1594 | COL1A2 | 3013105 | AAATTGGAGCTGTTGGTAACGCTGGTCCTGCTGGTCCCGCCGGTCCCCGTGGTGAAGTGGGT CTTCCAGGC |
| 1595 | COL1A2 | 3013106 | GTAATCCTGGAGCAAACGGCCTTACTGGTGCCAAGGGTG |
| 1596 | COL1A2 | 3013107 | CTCCCTGGACCCCGCGGTATTCCTGGCCCTGTTGGTGCTGCCGGTGCTACTGGTGCCAGAGGAC |
| 1597 | COL1A2 | 3013109 | GCCCTAATGGGGAAGCTGGATCTGCCGG |
| 1598 | COL1A2 | 3013110 | GGTAGTCCTGGTTCTCGTGGTCTTCCTG |
| 1599 | COL1A2 | 3013111 | GGCCCTCCTGGTAGTCGTGGTGCAAGTGGCCCTGCTGGAGTCCGAGGACCTAATGGAGATGC TGGTCGCCCTGGGGAGCCTGGTCTCATGGGACCCA |
| 1600 | COL1A2 | 3013113 | TCCCCTGGAAATATCGGCCCCGCTGGAAAAGA |
| 1601 | COL1A2 | 3013114 | TCCCTGGCATCGACGGCAGGCCTGGCCCAATTGGCCCAGCTGGAGCAAGAGGAGAGCCTGG CAACATTGGATTCCCTG |
| 1602 | COL1A2 | 3013115 | GGTGATCCTGGCAAAAACGGTGATAAAGGTCATGC |
| 1603 | COL1A2 | 3013116 | TCCAGGTCCTGATGGAAACAATGGTGCTCAGGGACCTCCTGG |
| 1604 | COL1A2 | 3013118 | CCTCAGGTCCCGCTGGTGAAGTTGGCAAACCAGG |
| 1605 | COL1A2 | 3013119 | GGTCTCCATGGTGAGTTTGGTCTCCC |

TABLE 13-continued

Subtyping Target Sequences

| SEQ ID NO. | Gene | Affy Probeset ID | Sequence |
|---|---|---|---|
| 1606 | COL1A2 | 3013120 | TGAGAGTGGTGCTGCCGGTCCTACTGGTCCTATTGGAAGCCGAGGTCCTTCTGGACCC |
| 1607 | COL1A2 | 3013121 | CTGCCTGGAATAAGTAGACCCTTTACAATAGAAAGATAATTGTTTTTCAGATTTTTATTTATTTC CAGTTCTGTGATGACTTCCCTCTCAGTAAACAGCAATCCGATTCCAGTGGACCTGAATTATTCT AAA |
| 1608 | COL1A2 | 3013123 | GAATCGCAGCTGTGCACTCCCACTACCCTCATCTCTTCAGTCACCATGTCATTAACAGCATCTC TCTCTGCTATATTCTCCCTCCTTTCAATAGCCCAGCCTTCTTTGTGTTTCAAAGCAGGCAAGAAG CCTGTCTAGCTAGCTGTTTAAATTGGAATTC |
| 1609 | COL1A2 | 3013124 | GGTTGGTGCTGTGGGCACTGCTGGTCCATCTGGTCCTAGTGGACTCCCAGGAGAGGGGT GCTGCTGGCATACCTGGAGGCAA |
| 1610 | COL1A2 | 3013125 | GGTGAACCTGGTCTCAGAGGTGAAATTGGTAACCCTGGCAGAGAT |
| 1611 | COL1A2 | 3013126 | AGACATGTTTCCTTTTTGGTACTAG |
| 1612 | COL1A2 | 3013127 | TCCTGGTGCTGTAGGTGCCCCTGGTCCTGCTGGAGCCACAGGTGACC |
| 1613 | COL1A2 | 3013129 | GGTGAACGTGGTGAGGTCGGTCCTGCTGGCCCCAATGGATTTGCTGG |
| 1614 | COL1A2 | 3013130 | TGCTGCTGGTCAACCTGGTGCTAAAGGAGAAAGAGGAGCCAAAGGGCCTAAGGGTGAAAAC GGTGTTGTTGGTCCCACAGGCCCCGTTGGAGCTGCTGGCCCA |
| 1615 | COL1A2 | 3013131 | TATATCCGTCAAGTGCCTGCTATGCAACAGGGAATATACCAGATAGAAGATGGAAAATAACG GAAGGATTAACATTTGCACACTGCTTTACAAAGTATAAAAGTTTCATGAATATTGTTTTATTTT AATTCTCTGATAACCTCATAAGGGTGGTAATATTGAAGAACATTCTGACACAGATAGTCATTTT TTATTTCTATATTTTCTTCTAAGAGATGCGGGAATGATCC |
| 1616 | COL1A2 | 3013132 | CCAAATGGTCCCCCCGGTCCTGCTGGAAGTCGTGGT |
| 1617 | COL1A2 | 3013133 | TTACAATGGACTCTCGCCGCTTTTCTTTTTTCAGAATCTATTAAGGACACTTGAAAGTTTTGAA ATTTTTGGTAAATTTGGACTACCATGAGGAAACTTTTGAGATTCAAGTTCATTCTATTCAGAGC AATTCCGATATTGATGTTAACTTGAACTCAGCTGGAACTCAGTGTATGTTGCTATCAGCTCACT TG |
| 1618 | COL1A2 | 3013135 | TGGTGCTGCTGGACGGACTGGTCCCCCAGGAC |
| 1619 | COL1A2 | 3013137 | AAAGAAGGGCTTCGTGGTCCTCGTGGTGACCAAGGTCCAGTTGGCCGAACTGGAGAAGTAG GTGCAGTTGGTCCCCCTGGCTTCGCTGGTGAGAAGGGTCCCTCT |
| 1620 | COL1A2 | 3013138 | AGCCAGGAAATCTGTCCAGCACACACTGAGGGGCTGTGGCTTCCAAGATGCTCAGAAAGCAC AAAATCGGGAAGACAATAAATGAGGGAACTCAGTTTTATCACAAAGCCCTTAAAGCTATTGA AGGCACCTTACTGGTACCAGGATTAGAACAGAGTCCCATTGCTGTGGCCATCCTACTACATAT TAATCAATCTCAGTAGGCTACCAATTTCTTAAACATACACTGTCCAGTATTAGTGCTACTCTGA AAGGTGCCC |
| 1621 | COL1A2 | 3013139 | GGTCTCCCTGGCTCGAGAGGTGAACGTGGTCTACCA |
| 1622 | COL1A2 | 3013140 | TGGGATACTGAATGACACGAGGCTCACTTTTTACAGAGCAACATCCCGTGATTACATAAAGCT GGCCATCTACATGTGGAGAAGGAGGGCAGAGATGATACTAATGATACTTCTTACCATTGTGT GACCCATTCACATTCAATTTACCTTCTTCCTTCAAACTAGAATCTCCTGAGTAGGGTTGTTTTGG AGGGGAAGGTTAGCATTCCATCGAATA |
| 1623 | COL1A2 | 3013141 | GTCCTCTTGGCATTGCCGGCCCTCCTGGGGCCCGTGGTCCTCCTGGTGCTGTGGGTAGTCCTG GAGTCAACGGTGCTCCTGGTGAAGCT |
| 1624 | COL1A2 | 3013143 | AGAGCGCGGTTACCCTGGCAATATTGGTCCCGTTGGTGCTGCAGGTGCACCTGGTCCTCATG GCCCCGTGGGTCCTGCTGGCAAACATGGAAACCGTGGTGA |
| 1625 | COL1A2 | 3013146 | ACAAGGCATTCGTGGCGATAAGGGAGAGCCCGGTGAAAAGGGGCCCAGAGGTCTTCCTGGC TTAAAGGGACACAATGGATTGCAAGGTCTGCCTGGTATCGCT |
| 1626 | COL1A2 | 3013147 | CTGTAGCCATCTCGCACATAAACTGATCCTGAAGGCCTTCAGCTCAGAAGGATTTTCATATTTT CACTGCTATTGTTCCAGTATAGCCTATATAATATCCATTTCCCATTCTCTGGCTAACTCCATCTC ACTCTTGGAGGTAATGCTATTTCATACCAACATGAAAGGTGAGGATTAAGGGAGATAGAAAT AGACATACAATAAAATCTCCTGGTAACAATGTCCTTCAACCCCACTTAAAATAAACATAATTAG AGGAATGACTAATATTGCACTGCTGA |
| 1627 | COL1A2 | 3013148 | CCATGGTGATCAAGGTGCTCCTGGCT |
| 1628 | COL1A2 | 3013151 | GATGGTCGCACTGGACATCCTGGTACAGTTGGACCTGCTGGCATTCGAGGCCCTCAGGGTCA CCAAGGCCCTGCT |

TABLE 13-continued

Subtyping Target Sequences

| SEQ ID NO. | Gene | Affy Probeset ID | Sequence |
|---|---|---|---|
| 1629 | COL1A2 | 3013152 | GATCACGGACCTAAGGAATGTTTTCTTCAGACTAAACCAAGACAACTTTGACAACCCATTAAA GTTAGCCCCATTTCAATATATCCTCTAAAATATCTGGAAATTGTCTATATGCAATGGGCTTGTT AAGTCCATCCCTGCAAGTGTGCCTGGGGGCTCGTTATTTATTTATGTGAACTTGATTATTTTTT ACTGATGAGAACATGCTTCCGTGTGAAGCTCAACTGAAAATCTGCTGCCATGGATGTCTCTCA CTGTAACAAAATA |
| 1630 | COL1A2 | 3013153 | ACTTTGGTTACGATGGAGACTTCTACAGGGCTGACCAGCCTCGCTCAGCACCTTCTCTCAGAC CCAAGGACTATGAAGTTGATGCTACTCTGAAGTCTCTCAACAACCAGATTGAGACCCTTCTTA CTCCTGAAGGCTCTAGAAAGAACCCAGCTCGCACATGCCGTGACTTGAGACTCA |
| 1631 | COL1A2 | 3013155 | CCAAGGATGCACTATGGATGCTATCAAAGTATACTGTGATTTCTCTACTGGCGAAACCTGTAT CCGGGCCCAACCTGAAAACATCCCAGCCAAGAACTGGTATAGGAGCTCCAAGGACAAGAAAC ACGTCTGGCTAGGAGAAACTATCAATGCTGGCAGCC |
| 1632 | COL1A2 | 3013156 | GGAGTGACTTCCAAGGAAATGGCTACCCAACTTGCCTTCATGCGCCTGCTGGCCAACTATGCC TCTCA |
| 1633 | COL1A2 | 3013157 | TTGCATACATGGATGAGGAGACTGGCAACCTG |
| 1634 | COL1A2 | 3013158 | GCTGTCATTCTACAGGGCTCTAATGATGTTGAACTTGTTGCTGAGGGCAACAGCAGGTTCACT TACACTGTTCTTGTAGATGGC |
| 1635 | COL1A2 | 3013159 | TTCTTGAGACTTCAGTGGCCTAAACTATAATTTATAGTTATGTGTATTTTATTTTACTTATTAGT ATGGCCTACATTTAACTTTTAATGCTTTTTCTACAATATGCTATAAATATAAGAAAAATTAAAT TCACTAACAGCAAGACTACATACCCACCCAGGTCCCGCTCCCAAAGACACACATAGAGGGAC ATACACACAACAATCCTAAAAATGACTTTGTAGAGATAGGTCACTTGGAATGTGTGTTGAAAT GTTGTTGGTTTTTTGGTTTGTTTGTTTGTTTGTTTTTTGTTAGACTGATAGGGAGCCCCTCCCA CTAAAGACACCCTTGATACTGTTATTTCAAGGATGAACTTATTTATCTGGGACAGACATCTTCA GAATGACACATGCCAAACAGTGGTTCTTA |
| 1636 | COL1A2 | 3013160 | GGGGAAAGACAATCATTGAATACAAAACAAATAAGCCATCACGCCTGCCCTTCCTTGATATTG CACCTTTGGACATCGGTGGTGCTGACCAGGAATTCTTTGTGGACATTG |
| 1637 | COL1A2 | 3013161 | ACATCTACTTGCTTAAATTGTGGGCAAAAGAGAAAAAGAAGGATTGATCAGAGCATTGTGCA ATACAGTT |
| 1638 | COL1A2 | 3013162 | TTCAACACTCTTACACCTGTTATGGAAAA |
| 1639 | COL1A2 | 3013163 | TTTCCCATGAGTGTGATCCACATTGTTAGGTGCTGACCTAGACAGAGATGAACTGAGGTCCTT GTTTTGTTTTGTTCATAATACAAAGGTGCTAATTAATAGTATTTCAGATACTTGAAGAATGTTC ATGGTGCTAGAAGAATTTGAGAAGAAATACTCCTGTATTGAGTTGTATCGTGTGGTGTATTTT TTAAAAAATTTGATTTAGCATTCATATTTTCCATCTTATTCCCAATTAAAAGTATGCAGATTATT TGCCCAAATCTTCTTCAGATTCAGCATTTGTTCTTTGCCAGTCTCATTTTCATCTTCTTCCATGGT TCCACAGAAGCTTTGTTTCTTG |
| 1640 | MET | 3020344 | GAGCCGAGTGGAGGGCGCGAGCCAGATGCGGGGCGACAGCTGACTTGCTGAGAGGAGGCG GGGAGGCGCGGAGCGCGCGTGTGGTCCTTGCGCCGCTGAC |
| 1641 | MET | 3020348 | CGCGGAAACACCCCATCCAGAATGTCATTCTACATGAGCATCACATTTTCCTTGGTGCCACTAAC TACATTTATGTTTTAAATGAGGAAGACCTTCAGAAGGTTGCTGAGTACAAGACTGGGCCTGTG CTGGAACACCCAGATTGTTTCCCATGTCAGGACTGCAGCAGCAAAGCCAATTTATCAGGAGGT GTTTGGAAAGATAACATCAACATGGCTCTAGTTGTCGACACCTACTATGATGATCAACTCATT AGCTGTGGCAGCGTCAACAGAGGGACCTGCCAGCACATGTCTTT |
| 1642 | MET | 3020349 | GTTCACTGCATATTCTCCCCACAGATAGAAGAGCCCAGCCA |
| 1643 | MET | 3020350 | CGCCCTGGGAGCCAAAGTCCTTTCATCTGTAAAGGACCGGTTCATCAACTTCTTTGTAGGCAA TACCATAAATTCTTCTTATTTCCCAGATCATCCATTGCATTCGATATCAGTGAGAAGGCTAAAG GAAACGAAAGATGGTTTTATGTTTTTGACGGACCAGTCCTACATTGATGTTTTACCTGAGTTCA GAGATTCTTACCCCATTAAGTATGTCCATGCTTTGAAAGCAACAATTTTATTTACTTCTTGACG GTCCAAAGGGAAACTCTAGATGCTCAGACTTTTCACACAAGAATAATCAGGTTCTGTTCCATA AACTCTGGATTGCATTCCTACATGGAAATGCCTCTGGAGTGTATTCTCACAGAAAAGAGAAAA AAGAGATCCACAAAGAAGGAAGTGTTTAATATACTTCAGGCTGCGTATGTCAGCAAGCCTGG GGCCCAGCTTGCTAGACAAATAGGAGCCAGCTGAATGATGACATTCTTTTCGGGGTGTTCGC ACAAAGCAAGCCAGATTCTGCCGAACCAATGGATCGATCTGCCATGTGTGCATTCCCTATCAA ATATGTCAACGACTTCTTCAACAAGATCGTCAACAAAAACAATGTGAGATGTCTCCAGCATTTT TACGGACCCAATCATGAGCACTGCTTTA |
| 1644 | MET | 3020363 | AGCGCGCCGTGATGAATATCGAACAGAGTTTACCACAGCTTTGCAGCGCGTTGACTTATTCAT GGGTCAATTCAGCGAAGTCCTCTTAACATCTATATCCACCTTCATTAAAGGAGACCTCACCATA GCTAATCTTG |
| 1645 | MET | 3020365 | TTGTGGTTTCTCGATCAGGACCATCAACCCCTCATGTGAATTTTCTCC |

TABLE 13-continued

Subtyping Target Sequences

| SEQ ID NO. | Gene | Affy Probeset ID | Sequence |
|---|---|---|---|
| 1646 | MET | 3020366 | TCACGAAGATCCCATTGAATGGCTTGGGCTGC |
| 1647 | MET | 3020367 | TGGCTGGTGCCACGACAAATGTGTGCGATCGGAGGAATGCCTGAGCGGGACATGGACTCAACAGATCTGTCT |
| 1648 | MET | 3020374 | ATATGTGGCTGGGACTTTGGATTTCGGAGGAATAATAAATTTGATTTAAAGAAAACTAGAGTTCTCCTTGGAAATGAGAGCTGCACCTTGACTTTAAGTGAGAGCACGATG |
| 1649 | MET | 3020377 | ATTGAAATGCACAGTTGGTCCTGCC |
| 1650 | MET | 3020378 | AATTATTTCAAATGGCCACGGGACAACACAATACAGTACATTCTCCTATG |
| 1651 | MET | 3020379 | TAATAACAAGTATTTCGCCGAAATACGGTCCTATGGCTGGTGGCACTTTACTTACTTTAACTGGAAATTACCTAAACAGTGGGAATTCTAGACACATTTCA |
| 1652 | MET | 3020380 | AACAGTATTCTTGAATGTTATACCCCAGCCCAAACCATTTCAACTGAGTTTGCTGTTAAATTGAAAATTGACTTAGCCAACCGAGAGACAAGCATCTTCAGTTACCGTGAAGATCCCATTGTC |
| 1653 | MET | 3020381 | TACTTGGTGGAAAGAACCTCTCAACATTGTCAGTTTTC |
| 1654 | MET | 3020382 | TGGTGGGAGCACAATAACAGGTGTTGGGAAAAACCTGAATTCAGTTAGTGTCCCGAGAATGGTCATAAATGTGCATG |
| 1655 | MET | 3020384 | GCATGTCAACATCGCTCTAATTCAGAGATAATCTGTTGTACCACTCCTTCCCTGCAACAG |
| 1656 | MET | 3020385 | CATGTTAGATGGGATCCTTTCCAAATACTTTGATCTCATTTATGTACATAATCCTGTGTTTAAGCCTTTTGAAAAGCCAGTGATGATCTCAATGGGCAATG |
| 1657 | MET | 3020387 | TGAAGCAGTTAAAGGTGAAGTGTTAAAAGTTGGAAATAAGAGCTGTGAGAATATACACTTACATTCTGAAGCCGTTTTATGCACGGTCCCCAATGACCTGCTGAAATTGAACAGCGAGCTAAATA |
| 1658 | MET | 3020388 | ATTCCTCTCATGATGTAAATAAGGAAGCCA |
| 1659 | MET | 3020389 | GTAATTATGTTATTCTCAGGCTTAAAATAAATCATTAAAGCTCATTTATGTGT |
| 1660 | MET | 3020390 | AAGCAATTTCTTCAACCGTCCTTGGAAAAGTAATAGTTCAACCAGATCAGAATTTCACAGGATTGATTGCTGGTGTTGTCTCAATATCAACAGCAC |
| 1661 | MET | 3020391 | TGGGCAGTGAATTAGTTCGCTACGATGCAAGAGTACACACTCCTCATTTGGATAGGCTTGTAAGTGCCCGAAGTGTAAGCCCAACTACAGAAATGGTTTCAAATGAATCTGTAGACTACCGAGCTACTTTTCCAGAA |
| 1662 | MET | 3020392 | TCAGAACGGTTCATGCCGACAAGTGCAGTATCCTCTGACAGACATGTCCCCATCCTAACTAGTGGGGACTCTGATATATCCAGTCCATTACTGCAAAATACTGTCCACATTGACCTCAGTGCTCTAAATCCAGAGCTGGTCCAGGCAGTCAGCATGTAGTGATTGGGCCCAGTAGCCTGATTGTG |
| 1663 | MET | 3020395 | GGCATTTTGGTTGTGTATATCATGGGACTTT |
| 1664 | MET | 3020396 | ATTTCTGACCGAGGGAATCATCATGAAAGATTTTAGTCATCCCAATGTCCTCTCGCTCCTGGGAATCTGCCTGCGAAGTGAAGGGTCTCCGCTGGTGGTCCTACCATACATG |
| 1665 | MET | 3020397 | GTAAAAGATCTTATTGGCTTTGGTCTTCAAGTAGCCAAAGGCATGAAATATCTTGCAAGCAAAAAGTTTGTCCACAGA |
| 1666 | MET | 3020399 | ACAGTCAAGGTTGCTGATTTTGGTCTTGCCAGAGACATGTATGATAAAGAATACTATAGTGTACACAACAAAACAGGTGCAAAGCTGCCAGTGAAGTGGATGGCTTTGGAAAGTCTGCAAACTCAAAAGTTTACCA |
| 1667 | MET | 3020401 | CCTTATCCTGACGTAAACACCTTTGATATAACTGTTTACTTGTTGCAAGGGAGAAGACTCCTACAACCCGAATACTGCCCAGACCC |
| 1668 | MET | 3020402 | TGCTGGCACCCTAAAGCCGAAATGCGCCCATCCTTTTCTGAACTGGTGTCCCGGATATCAGCGATCTTCTCTACTTTCATTGGGGAGCACTATGTCCATGTGAAC |
| 1669 | MET | 3020403 | GTGTCGCTCCGTATCCTTCTCTGTTGTCATCAGAAGATAACGCTGATGATGA |
| 1670 | MET | 3020404 | GTGGACACACGACCAGCCTCCTTCTGGG |
| 1671 | MET | 3020405 | GCAACAGTCCACACTTTGTCCAATGGTTTTTTCACTGCCTGACCTTTAAAAGGCCATCGATATTCTTTGCTCTTGCCAAAATTGCACTATTATAGGACTTGTATTGTTATTTAAATTACTGGATTCTAAGGAATTTCTTATCTGA |

TABLE 13-continued

Subtyping Target Sequences

| SEQ ID NO. | Gene | Affy Probeset ID | Sequence |
|---|---|---|---|
| 1672 | MET | 3020406 | ACCAGAGGCTTGGTCCCACAGGCCACGGACCAATGGCCTGCAGCCGTGACAACACTCCTGTCATA |
| 1673 | MET | 3020407 | CCAAAACTTGAATTCTGGGTTGAATT |
| 1674 | MET | 3020408 | GTACCACTTGATTTCATATGGGAAATTGAAGCAGGAAATATTGAGGGCTTCTTGATCAC |
| 1675 | MET | 3020409 | ACACTTTTGTGTGTTGTATGGTCAATAACATTTTTCATTACTGATGGTGTCATTCACCCATTAGGTAAACATTCCCTTTTAAATGTTTGTTTGTTTTTTGAGACAGGATCTCACTCTGTTGCCAGGGCTGTAGTGCAGTGGTGTGATCATAGCTCACTGCAACCTCCACCTCCCAGGCTCAAGCCTCCCGAATAGCTGGGACTACAGGCGCACACCACCATCCCCGGCTAATTTTTGTATTTTTTGTAGAGACGGGGTTTTGCCATGTTGCCAAGGCTGGTTTCAAACTCCTGGACTCAAGAAATCCACCCACCTCAGCCTCCCAAAGTGCTAGGATTACAGGCATGAGCCACTGCGCCCAGCCCTTATAAATTTTTGTATAGACATTCCTTTGGTTGGAAGAATATTTATAGGCAATACAGTCAAAGTTTCA |
| 1676 | MET | 3020410 | AGTTGTCATATAAAAACCCACTGTTTGAGAATGATGCTAC |
| 1677 | MET | 3020411 | AAGATTAGCCTCTGTCTCGGTGGCAGGTTCCCACCTCGCAAGCAATTGGAAACAAAACTTTTGGGGAGTTTTATTTTGCATTAGGGTGTGTTTTATGTTAAGCAAAACATACTTTTAGAAACAAATGAAAAAGGCAATTGAAAATCCCAGCTATTTCACCTAGATGGAATAGCCACCCTGAGCAGAACTTTGTGATGCTTCATTCTGTGGAATTTTGTGCTTGCTACTGTATAGTGCATGTGGTGTAGGTTACTCTAACTGGTTTTGTCGACGTAAACATTTAAAGTGTTATATTTTTATAAAAATGTTTATTTTAATGATATGAGAAAAATTTTGTTAGGCCACAAAAACACTGCACTGTGAACATTTTAGAAAAGGTATGTCAGACTGGGATTAATGACAGCATGATTTTCAATGACTGTAAATTGCGATAAGGAAATGTACTGATTGCCAATACACCCCACCCTCATTACATCATCAGGACTTGAAGCCAAGGGTTAACCCAGCAAGCTACAAAGAGGGTGTGTCACACTGAAACTAATAGTTGAGTTTGGCTGTTGTTGCAGGAAAATGATTATAACTAAAAGCTCTCTGATAGTGCAGAGACTTACCAGAAGACACAAGGAATTGTACTGAAGAGCTATTACAATCCAAATATTGCCGTTTCATAAATGTAATAAGTAATACTAATTCACAGAGTATTGTAAATGGTGGATGACAAAAGAAAATCTGCTCTGTGGAAAGAAAGAACTGTCTCTACCAGGGTCAAGA |
| 1678 | MET | 3020412 | TCATGCAATTAAAGTAAAGTGATGC |
| 1679 | CALD1 | 3025546 | GAGCTGAGAGTTAAGCTGAACAAAA |
| 1680 | CALD1 | 3025553 | TCCTGAGCATGCCTAGGGAATGACAGGCATCTCCACAGGCAGGCTGCATCCACCTTGGCTGGGGTGTCGTCATTGGCTGCCTATTAGAAAAACGACAGGACAATGCATACCACCGCCTCCCGACTGTAAACATAGGGGATATGTGTTCACTTAGCATGGACTTCTGGGAGGG |
| 1681 | CALD1 | 3025554 | TCCTCGGGAAGAAGTTTCAGACTACA |
| 1682 | CALD1 | 3025581 | AGATCATCAAATCAAATTCCACAGGGATTGGTGACCAA |
| 1683 | CALD1 | 3025586 | TGGCACAGAAACGCAGGGGAAACGGGCTCCTCATTTAAAGAGCTGGAAGGGGAAGGTCTTTCCGGAATTAAAACCATCACA |
| 1684 | CALD1 | 3025587 | TCCAGACATCATCTGGTCTCCCTGAACCTGAAATCACACC |
| 1685 | CALD1 | 3025588 | TGGATGATTTTGAGCGTCGCAGAGAACTTAGAAGGCAA |
| 1686 | CALD1 | 3025589 | AAGGATCTAGGGTGAAAAATACTTGTAT |
| 1687 | CALD1 | 3025590 | CTTTTGAGAGGCCAAATGTGGTCATATCGCACACCAAACTGTTCGCAAAAGTAGTT |
| 1688 | CALD1 | 3025591 | TGAGAGGAATCAATTGATAACTGCATATTGATAATTGCATTTAATCAATACCTTTCACATTGGAATGTTTTAAATGACAAAAGTAATGTGTGAATGAAGGTTTAAAAAGCTTATATAATAAGAAATGACAAAAAAATGTCAAGTATTGAATATTGGAACCACTTAGGACATG |
| 1689 | CALD1 | 3025612 | GGATCCGGATCGCATGGAAGACGCAGCCTGGCCGCGCTCT |
| 1690 | CALD1 | 3025614 | GGAATGTCTACATTCACCTTTTCTAGGAGTCAGTTCTCCAAATCACTCTACCTTTCACTTTGTAAG |
| 1691 | CALD1 | 3025621 | ATTGAGTATCTCAGTTACCAGCCTGAAATCTCCATCGACCAACACTGCCTTCTCTCAAATGACTTCTTATATGAAAGTGGACAGACAGTGGAATGCAGAAATTTTAGAGCTGATCTTGGGGACCGGTCAACTGT |
| 1692 | CALD1 | 3025626 | GCCGCCGAGCCCGACAGGAACGGCTGCGGCAGAAGCA |
| 1693 | CALD1 | 3025628 | ATGATGAGGCCGCATTCCTGGAGCGCCTGGCTCGGCGTGAGGAAAGACGCCAAAAACGCCTTCAGGAGGCTCTGGAGCGGCAGAAGGAGTTCGACCCAACAATAACAGATGCAAGTCTGTCGCTCCCAAGCAGAAGAATGC |
| 1694 | CALD1 | 3025629 | CTACCAGAAGAATGATTGGAGGGATGCTGAAG |

TABLE 13-continued

Subtyping Target Sequences

| SEQ ID NO. | Gene | Affy Probeset ID | Sequence |
|---|---|---|---|
| 1695 | CALD1 | 3025630 | GAGGAGAAGCCAAAGCGAGGGAGCATTGGAGAAAAT |
| 1696 | CALD1 | 3025631 | GGCAGATCAGTTCAGAAGAGCCTAAACAAGAGGAGGAGAGGGAACAAGGTTCAGATGAGATT |
| 1697 | CALD1 | 3025632 | AGAGAAAGAATTAAAGCCGAGCAAGACAAAAAGATAGCAGATGAACGAGCAAGAATTGAAGCA |
| 1698 | CALD1 | 3025633 | AGAGAGGGAAAGGATGAGGGAGGAAGAGAAA |
| 1699 | CALD1 | 3025634 | AGGAGAGGCAGAGGATAAAAGAGGAAGAGA |
| 1700 | CALD1 | 3025635 | AGAGCAGAAACGTAACAAGCAGCTAGAAGAGAAAAAACATGCCATGCAAGAGACAAA |
| 1701 | CALD1 | 3025638 | GAGAAGAGAAGGGAACTAAAGTGCAAGCTAAAAGAGAAAAGCTCCAAGAAGACAAGCCTACCTTCAAAA |
| 1702 | CALD1 | 3025644 | GTTAAGAGCTTCATGGATCGAAAGAAGGGATTTACAGAAGTTAAGTCGCAGAATGGAGAATTCATGACCCACAAACTTAAACATA |
| 1703 | CALD1 | 3025649 | GAGGGAGGGCCAGCGTGGACACCAAGGAGGCTGAGGGCGC |
| 1704 | CALD1 | 3025650 | AAGGCTGGAGGAGCTTCGTCGTCGTCGCGGGGAGACCGAGAGCGAAGAGTTCGAGAAGCTCAAACAGAAGCAGCAGGAGGCGGCTTTGGAGCTGGAGGAACTCAAGAAAAAGAGGGAGGAGAGAAGGAAGGTCCTGGAGGAGGAAGAGCAGAGGAGGAAGCAGGAGGAAGCCGATCGAAAACTCAGAGAGG |
| 1705 | CALD1 | 3025651 | CTAGCCCACTGAGAACGTTGCCCGGGAAAATTCCCTAGTGCCGTGCGGCTGTTCTTTTGAGCATGGGCTCTCAAAAATATTTTTTTAAGAATAATAAACTTACCATGTGCTAGGTACTGTTTTATAACTTGTAGATGTATTAATTTGTCCACTGCTTCAAGAACTCGCTGACCTAGGTACTAATCCCCATTTTACAGATGAGAAAACTGAGGCACAGAGAGGTTTTGTTTTTGTTTTTGTTTTGTTTGTAACTTTCCCAAGGTCTCCCTTGAGTCTGCCTGACATG |
| 1706 | CALD1 | 3025654 | TAGAAGAGCGAGCAGAATTTTTGAATA |
| 1707 | CALD1 | 3025658 | AAGCGCAAAACCTACAAAGCCGGCAGCCTCGGATCTTCCTGTTCCTGCTGAAGGTGTACGCAACATCAAGAGTA |
| 1708 | CALD1 | 3025659 | GCATGTCGATTTTGATTTAGGAATCACACTAGTAAATAATAAAAGCAGTGAAGAAGGTGCAATTTGTACTTTGTTTTGCAATGACCACAAAAGCAAGCTCAGAGAGAATGTGTTTGTGAGGTTGCATGAGGTACTAAGCCCGGGCCATCTTACTCCAAATAAAGTGCCTGGGCTGAAATGTCCACCCTTGGAGTT |
| 1709 | CALD1 | 3025660 | TTGAAGGTAGGGGTTTCTAGCCGCATCAATGAATGGCTAACTAAAACCCCAGATGGAAACAAGTCACCTGCT |
| 1710 | CALD1 | 3025661 | TCTGAGTTTCTTTGATCTCCCAGCT |
| 1711 | CALD1 | 3025662 | CAGATTTACAACAGTTCTAAGAAGCTGCATCTCAGTTACTCAGAGGGTAAAATGGAACCAAATAATCACCTCTACACCCTAACTGAGAGGAGGAATCAGCTAGAATACTGA |
| 1712 | CALD1 | 3025663 | CCTAGGCCTCTGTGCATTTAATTGCATCCATTGGCTCCATGCCATTTAATTGCATTTGTTGGCTCCATATATAATCTCCAAAGTCATTAAATTTTGTCACTTTCCAATTTAAAAAGGAAGAAATGGAAATGTTCACAAATCCTTCTTGGGCACAACTCCTTGAACCGTTTAATTAATCTACACCCCGAGATTCTTTGCATAAAGGCTCACAGGAGGTATACACTAATGTCAACCCAATTTACAATTGGAAAATCTTTATACATTGAAAAAGCAACTTTTCCTCCCCCTCTCAATAGGTACAAGAATGCGGGTTTATAAAAGGACACAGTTGAGGCAAGAGACCGGACCCAAAAGTTATGTGCTCTTTAGTGCCTCAAGTTTTCCAAGCATCTCTGGTAACATAAGGAGTAGAAATTATTTTCAAAAACAAAATAATCACTGGTTCCAGACCAGTGATTATTAACCCTTTTTGAATTATGAACCCCTTTAAAACCTAATGAAATTTAAGGACCCTCTCCCCAAAATATACATATAAAAAAACAAGGCAGTCTATGGACCTACTGAGTAACTCTCAAGATAGTAAGTAAGGAGAAAAGATCTATGTTTCCCTCTTTGATAAGTATGAAATATTTGGAGGAGATGCTAATTTTTGCACGTTTATGATATTTGCAATCTTTCATTTTTGTAGCAGATTATACTCAAAAATTTGATCCAGAACTTGGCCCCTATTCTTTTATCAGCACTTTAACTTGTAAACTGAAAAGTTTACCATCATCTGTATGACATCCTAATGAGGTTAAAAAGATAAAATGCAGTTATGATTATGATAGGTATAACTGTATCCAGGTTTCCACAGCAAAAACAAAACAAAACATACACCATGTTCTGGGGTTATTGACA |
| 1713 | CALD1 | 3025664 | TGACCTTCTGTTCCTCACTCTTTGGTCTCTGGTTGATTGGAAACCTGCTTCTCCTGCCTTCATTTCTCCCTCTTCTTCCGGAGTGGGTCTTTCTC |
| 1714 | CALD1 | 3025668 | TTGAGACCAGGAGAGACGTATCCAGCAAGCGGAACCTCTGGGAAAAGCAATCTGTGG |

TABLE 13-continued

Subtyping Target Sequences

| SEQ ID NO. | Gene | Affy Probeset ID | Sequence |
|---|---|---|---|
| 1715 | CALD1 | 3025673 | GACGAGCTCAGTTGTAGAGGGCTAATTCGCTCTGTTTTGTATTTATGTTGATTTACTAAATTGG GTTCATTATCTTTTATTTTTCAATATCCCAGTAAACCCATGTATATTATCACTATATTTAATAATC ACAGTCTAGAGATGTTCATGGTAAAAGTAC |
| 1716 | CALD1 | 3025674 | GCTGTGAAATAGAGACTTTTCTACTGATCATCATAACTCTGTATCTGAGCAGTGATACCAACCA CATCTGAAGTCAACAGAAGATCCAAGTTTAAAATTGCCTGCGGAATGTGTGCAGTATCTA |
| 1717 | CALD1 | 3025675 | TTTAGTAGTGATAGTAGCCTGAACCACATTTTAGATAACTCAATTATGTATGTATGTGCATACA CATATACAAACACACTAATGGTAGAATGCTTTTTTATGTGCTAGACTATTATATTTAGTAGTAT GTCATTGTAACTAGCCAATATCACAGCTTTTGAAAAATTAAAAAATCACACTATATTAATATTT TATATTTGCCAACAGAAACATGGCAGATAGGTATCAATATGTTTTCAATGCCTGATGACCTAT AAGAAGAAAGTA |
| 1718 | CALD1 | 3025676 | TCACAATAGGTCATAAGGTCTCTTCCTTTTCTAAAATTGAAAGACAAGAAATTTAGTGCCAATA TTGTACAGACAGAAATTCCATGTATGAGTCTCAACAAAGACTACCTTTGGCTAAATGTCTAGA AGCAGAGAAGTAAAGTGAGCAAAATCCAGTGTTGAGGAGTCATGACAGTACTTTGATCTTTA TATACTCTGAAGCATTTCTTCAAACTTTTCTACTTTTATTTGTCATTGATACCTGTAGTAAGTTG ACAATGTGGTGAAATTTCAAAATTATATGTAACTTCTACTAGTTTTACTTTCTCCCCCAAGTCTT TTTTAACTCATGATTTTTACACACAATCCAGAACTTATTATATAGCCTCTAAGTCTTTATTCTT CACAGTAGATAATGAAAGAGTCCTCCAGTGTCTTGGCAAAATGTTCTAGTATAGCTGGATACA TACAGTGGAGTTCTATAAACTCATACCTCAGTGGACTTAACCAAAATTGTGTTAGTCTCAATTC CTACCACACTGAGGGAGCCTCCCAAATAACTATTTTCTTATCTGCAGTATTCCTCCAGAAGAGC TAACCAGGGCAGGGCTGGCATGAGAAGTGACATCTGCGTTACAAAGTCTATCTTCCTCATAA GTCTGTAAAGAGCAATTGAATCTTCTAGCTTTAGCAAACCTAAGCCAAAGGAAGGAAAGCCA TGAAGAATGCAGAAGTCAAACCCTCATGACAAAGTAGGCACAAGTCTACAATAAGCTAAATC AGAATTTACAAATACAAGTGTCCCAGGTAGCATTGACTCCCGTCATTGGAGTGAAATGGATCA AAGTTTGAATTAAGGCCTATGGTAAGGTAACATTGCTTTGTTGTACTTTTGAACAAGAGCTCCT CCTGATCACTATTACA |
| 1719 | CALD1 | 3025677 | ATATTGATAGTGAGAGGTATGTCTATTATAA |
| 1720 | AGR2 | 3039796 | CTCTGGCCAGGAACTCTAAGGTACACACTTTCATTTAGTAATTAAATTTTAGTCAGATTTTGCC CAACCTAATGCTCTCAGGGAAAGCCTCTGGCAAGTAGCTTTCTCCTTCAGAGGTCTAATTTAGT AGAAAGGTCATCCAAAGAACATCTGCACTCCTGAACACACCCTGAAGAAATCCTGGGAATTG ACCTTGTAATCGATTTGTCTGTCAAGGTCCTAAAGTACTGGA |
| 1721 | AGR2 | 3039797 | TCTCCAAGCCCTTCTGTCTGTCAGGCCTTGAGACTTGAAACCAGAAGAAGTGTGAGAAGACTG GCTAGTGTGGAAGCATAGTGAACACACTGATTAGGTTATGGTTTAATGTTACAACAACTATTT TTTAAGAAAAACAAGTTTTAGAAATTTGGTTTCAAGTGTACATGTGTGAAAACAATATTGTAT ACTACCATAGTGAGCCATGA |
| 1722 | AGR2 | 3039798 | GAAAGCTCTCAAGTTGCTGAAGACTGAATTGTAA |
| 1723 | AGR2 | 3039800 | AGAGAGCTAGGCTTAGGGACGCCTCGGACTCAGTTTGACCCTAACTAGCCTTGCATCTTCAGG CAAATCACACTCTTTC |
| 1724 | AGR2 | 3039801 | GTAAGTGTGACCTTCAATTCGGATGTTGCCCAAGAGTTGAACACCTCTATTGCTGTAGTGATG GGACTA |
| 1725 | AGR2 | 3039809 | ACAACTGACAAACACCTTTCTCCTGATGGCCAGTATGTCCCCAGGATTATGTTTGTTG |
| 1726 | AGR2 | 3039810 | TTAAAGAAAGTGTTTGCTGAAAATAAAGAAATCCAGAAATTGGCAGAGCAGTTTGTCCTCCTC AATCTG |
| 1727 | AGR2 | 3039812 | AAGAAGCTCTATATAAATCCAAGACAAG |
| 1728 | AGR2 | 3039813 | TAGGAGTCAGCTTCTTGTTGGCTTCCAACTGCTACTTAATTGGAAAAGATTTC |
| 1729 | AGR2 | 3039814 | TCAGCATTCTTGCTCCTTGTGGCCCTCTCCTACACTCTGGCCAGAGATACCACAGTCAAACCTG GAGCCAAAAAGGACACAAAGGACTCTCGACCCAAACTGC |
| 1730 | AGR2 | 3039819 | GCCACGATGAATTAGGAGAACAAGATGTCAAATTACACTGATGCTGAGTCAAGCTTCTCAAAG |
| 1731 | MACC1 | 3040557 | GGTGATCGGATGTTCTTTCTAAGGATCATATTCCACATTTAAAGAGATGGTGACTGAGAAGAG GTGGCAAGCTGAACCATCTCACTTTGAGATTGACGTATCACGTTTTATCCTCTGCCATCATTTC CTTGTTAATTGTTTTTCTTTGGGTGATTGGAAGAATCTATGGCTTCCTTTTCTCTGTTCTTAAAG ATATCAAGACTCTGCCCTTTTGTGACTGGAAGTAGATTTAAATGTCCCTAATGTTTATATGCT CACTTAAACTCAATACATGGAATTTACTGGGCATTTAACTTGTTCATG |
| 1732 | MACC1 | 3040558 | CATTGGTTTCACTAGGAGCTTCTCAAAGCACGCTGCCAAACATGCTCCAGTCTCATTGTCAAG GCCTTAGACCAGGCAATCATTACGGCAGTGGTTCTTCAACTTCAGCAGCAGCAAAACGATCTG GCGGGGGCTTGGTGAAACAGACTGCTGGGCTCGACCACCAGAATTTCTCATTCAGAGGGTCT GGCCTGATCACTTGCATTT |

TABLE 13-continued

Subtyping Target Sequences

| SEQ ID NO. | Gene | Affy Probeset ID | Sequence |
|---|---|---|---|
| 1733 | MACC1 | 3040559 | TTCATGGCCTGTAATGTAGAACATACTATATAAAGTTCTCAGTTTGGGGATGACTAGGTTTCT GGAAGGAATAGAATGCTAAATCAATGGATGGCATTGGGCTGAGAAACACTGCTGCTACTAAT CAGCCTTGAATGTGTAATGTGAACATGCAAAAGAGAACATGCATACACTCAAATTTGTACAAT GCTATAACTGGAAGTTGAAGGACTTGAATTTTTATATTGTGCTATTGTTATGTTTTCTGTAATT GTTTATATCTAAGGAATTTTTGAGGTAATATAAAAGAAAAAGAGAATAATGAACAATGATGTC ACTGGAGGGTTTTTACATTAAATTAGATCATTTTTCTTCTTATTCACAATAATAATCTTAATCTTT AAGAATTAATTATAATTTAATATTATAATTCATAATCTTTAAGAATTAATAATTATAATTTAATA TTATAATTAATAATCTTTAAGAATTAATAATATAATTTAATATTATAATTAATAATCTTTAAGAA TTAATAATTACAATTAATAATTAATAATAATCTTAATCTTTAAGAATTAATAATAATCCTTAATC GCAATAATAATCGCAAGGAGGAGAAGTAAGTCCCTCCTCCTTCTGTATGAACTTTTCTCCCAC ATGCTGCTGTATGGTTTAGTGAGAGTGAAGTTCTAAAGAACATCAATATGATTGGTGGGATA ATCCAAAGACATTTTTTCAGAATCAAATGGCATGTCGAAGGTTTGTTTCTTGCATATGTATTTA CTGGTCCACAGC |
| 1734 | MACC1 | 3040560 | CACCCTGGGATATTTGGTATGCTGGCAATGGTAATTCAAATTGGCGTTTAAGAATAATCTTGG CCG |
| 1735 | MACC1 | 3040561 | GGACCCTGGGTCAGTATAAATGCTAATGGCTGACAAAGTTCACAAAGAGATGTATTTTGCTTA CTCCTCTGTTCAATCCTCTGGTTGCCTGCCAGTGTTTATGTGTGTATTTGGACAGACATTCATTT ATTGTCATTCAGTCAATAGGTAGAGTATATGTGTCTATTTTTTGGCAGGCATATAGATGCTTGA GGCTAATGGGAAAAAACCAGCATGAACTCTGACTTTAGTAGTGCTAAGTAATAGATAATTTTA AAAAATGACACCGTTAAATAGAAAATGGCATGCATACTAACAGTTGCAATGGAGAGGCTGTG ATGCTACAGAGATATAAACGTAGAGATGCCATCATGTGAAACTGGAAGTGGGGGTGGGTCAG GGAAATTTGTTCTTGGAAAGAAATAATGAACCTCAAGGAAGAGTAGGCATTGTCCTGGTGTG GTGGGGTGTAAGCGGTGATCCCACAAAGCACT |
| 1736 | MACC1 | 3040562 | AACAGTTGCCGTTTCATTTTAAGTGAGACTTGCTACTCTTTTTCATCGTCTCTTGAAAGACTGAC AGAAGGAAAATATGACTTATCAGAAATCTGTTGTCTGCATGCATGGACCTAGTGTTTTCATCA GCTCCCTTCAGCATCTTGGG |
| 1737 | MACC1 | 3040563 | CAAGCACACACCCTGTGGCCAGTCACGGCTGCCCGCTTTCCACACCTGACCTCTTCAGTTCATC AGTGGGTTCACCAGCATCACCCCCATTTTTTCATGGGGAGAAACTCAGAAGTGGAGAGAACG TCTGAGGCTACATAGCC |
| 1738 | MACC1 | 3040564 | CTGATGAAAGCACAGCCTAACTGATAACCAAGATGGGTTTTATCCTC |
| 1739 | MACC1 | 3040565 | GAAAATGAGGTAATGGTGTGTGTGT |
| 1740 | MACC1 | 3040566 | GAGATGTGTTACAAGACCTTCAGTCAGCTTTGGACAGAATGAAAAACCCTGTGACTAAACACT GGAGAGAATTAACTGGAGTTTTAATACTAGTAAATTCTTTGGAGGTTTTGAGAGTAACTGCAT TCTCCACTTCTGAGGAAGTATA |
| 1741 | MACC1 | 3040568 | TAGTCGCACGTCTCATCCAAGAAGCTGCTGTTCTGACTTCAGCTGTCAAGCTTGGAAAAGGCT GGAGGGAACTAGCTGAAAAGTTAGTACGACTCACAAAGCAACAAATGGAGGCATATGAAAT TCCTCATCGAGGA |
| 1742 | MACC1 | 3040569 | CAGAAAAGTTTATGATTGGAAAGTTTTAGCTGATGTCCTGGGTTACTCACATCTGTCCCTGG AAGATTTTGATCAAATTCAAGCAGACAAAGA |
| 1743 | MACC1 | 3040570 | TTTCAAAGGGGACACAATAGCTCTCCTCGGGGAAGGTAAGGTAAAAGCTATTGGTCAGTCCA AAGTGAAAGAATGGTATGTAGGAGTCCTCAGAGGTAAGATTGGACTTGTACACTGCAAAAAT GTCAAGGTGATTTCAAAGGAGCAAGTAATGTTTATGTCAGATAGTGTCTTTACAACCAGAAAT CTTCTTGAACAGATTGTCCTGCCTTTA |
| 1744 | MACC1 | 3040571 | TTTTGTGTTCAAGTGGAGCCTCCCAATGGTGAACCAGTTGCACAGTTCTCTATCACTACTCCTG ATCCAACCCCAAACCTAAAAAGACTCTCGAATCTGCCAGGCTATTTGCAGAAGAAGGAGGAA ATCAAGTCTGCTCCTTTATCACCAAAAATTCTTGTTAAATATCCTACATTTCAAGATAAAACATT GAACTTTAGCAACTATGGGGTAACCCTG |
| 1745 | MACC1 | 3040572 | GCCCGCTCCTGCCTTGATTTGAATACAATTAGTCAGAGCCCTGGATGGGCCCAGACACAACTT GCGGAGGTCACCATAGCTTGCAAAGTAAACCATCAAGGAGGGTCAGTACAATTACCTGAATC AGACATCACTGTTCATGTGCCCCAAGGTCATGTGGCTGTGGGAGAATTCCAAGAGGTGTCTCT AAGGGCTTTCCTTGATCCGCCACACATGCTTAACCATGATCTTTCGTGCACTGTGAGCCCGTTG TTGGAAATC |
| 1746 | MACC1 | 3040573 | CAAATCCATTCTGGAATCAACTGTCTGCTTCTAACCCATTTTTGGATGACATAACTCAACTAAG AAATAAC |
| 1747 | MACC1 | 3040574 | AGGACCCAGACTTGCTTCACAATTGGCCGGATGCTTTCACCCTTCGTGGTAATAATGCTTC |
| 1748 | MACC1 | 3040576 | AACATTTTCGGTCAGGAAGAATTGCACAAAGTAT |
| 1749 | MACC1 | 3040577 | AGGAGGGGTCACAGGTGAACGAGATGTGGTC |

TABLE 13-continued

Subtyping Target Sequences

| SEQ ID NO. | Gene | Affy Probeset ID | Sequence |
| --- | --- | --- | --- |
| 1750 | MACC1 | 3040579 | GTAGCCTTGTCAGATGATATGCAAA |
| 1751 | MACC1 | 3040587 | GAAGAAATTATAGGCGAGGCTGAGATCTAAAAGGAGAGCTCCAGAATGGAGGCTTGGACCA GGGGCAGACCAGGAGCTTATCAAGATACAATTGAATAATCAAAGGGTGGAGCCTGGACAAA |
| 1752 | MACC1 | 3040590 | CCGGGTTTGGTAGAGTGACTTCTATTCACTAAAACCATGTGTCTGAACTGAAGAAGCTTGGGC TCACTTCCA |
| 1753 | IGFBP3 | 3049293 | CTGGGCTTTGTATCACTAATTATTT |
| 1754 | IGFBP3 | 3049294 | GAGAAGTTTGTCTTGCAATGTATTTA |
| 1755 | IGFBP3 | 3049295 | TGCTGCAGACCTCGGTGTGGACACACGCTGCATAGAGCTCTCCTTGAAAACAGAGGGGTCTC AAGACATTCTGCCTACCTATTA |
| 1756 | IGFBP3 | 3049296 | GATGCTATATGATACAACTGTGGCCATGACTGAGGAAAGGAGCTCACGCCCAGAGACTGGGC TGCTCTCCCGGAGGCCAAA |
| 1757 | IGFBP3 | 3049297 | AGCGGCCGACCACTGACTTTGTGACTTAGGCGGCTGTGTTGCCTATGTAGAGAACACGCTTCA CCCCCACTCCCCGTACAGTGCGCACAGGCTTTATCGAGAATAGGAAAACCTTTAAACCCCGGT CATCCGGACATCCCAACGCATGCTCCTGGAGCTCACAGCCTTCTGTGGTGTCATTTCTGAAAC AAGGGCGTGGATCCCTCAACCAAGAAGAATGTTTATGTCTTCAAGTGACCTGTACTGCTTGGG GACTATT |
| 1758 | IGFBP3 | 3049299 | GTGTGGATAAGTATGGGCAGCCTCTCCCAGGCTACACCACCAAGGGGAAGGAGGACGTGCA CTGCTACAGCATG |
| 1759 | IGFBP3 | 3049303 | ACAGCCAGCGCTACAAAGTTGACTACGAGTCTCAGAGCACAGATACCCAGAACTTCTCCTCCG AGTCCAAGCGGGAGACAGA |
| 1760 | IGFBP3 | 3049304 | AAATGCTAGTGAGTCGGAGGAAGACCGCAG |
| 1761 | IGFBP3 | 3049306 | GTCAACGCTAGTGCCGTCAGCCGCCTG |
| 1762 | IGFBP3 | 3049307 | TGTGGCTCCGGCCTTCGCTGCCAGCCGTCGCC |
| 1763 | IGFBP3 | 3049308 | GTGCGACGCGCGTGCACTGGCCCAGTG |
| 1764 | IGFBP3 | 3049309 | GCGCGACCCACGCTCTGGGCCGCTGCG |
| 1765 | IGFBP3 | 3049310 | GCCCAGCCTGCCAAGCAGCGTGCCCCG |
| 1766 | IGFBP3 | 3049311 | CTGGGCGCTGAGGATCAGCCGCTTCCTGCCTGGATTCCACAGCTTCGCGCCGTGTACTGTCGC CC |
| 1767 | SAMD9 | 3061439 | CAGTCTTCTGAAGGTCATGCCCACAGAAGTCATCAGACCTTACCAAAGTAGGTTGGAGAATTA GATTGCCTTTTCATGCAGTGAGATTCAGTTAAGCAAAAATGAAATTTGTCTCTATAGCTAATTA GCTTATCAACTCCCCTCCAAACAAACAATTAAAAAAAAAACATACAGACACTCAAATTCCACAA GCTAATGAACAAAAGGGACTCTTGTGAGAAGACTAATGAGTCCCTCATCCAGAAGATGCCAA TGTACTGGCAGATTAACATACAACCTATGTTTTGAACAAAAACAACCAGCGATACGTAATCAA AATGTAATTTTCCCCTAATAAAATTATGGATATGGGCAGTCATCAATGGCTGCCAAAACCATT AAGTGGAAAGCTGATTAAAAAACAAAAATTTCTAATGGATTTATCAAACTGTCCCAAATCCTG ATAAATATTAACATCACAGAGGAAGACCAGACATTATGGGCCTGGAAGTACTATAGGAGTGC ACACATCACCCGTGACATGGTCTTGCCAAATAATTAAACCTGAATTTGATCAGGTCTCTGGATC TTATTTGCAATTCAAAAGAAATTTTAAAAAAATCCTACTAACACCACCACAAATATGCAATCAG CAATATCCAGAAAGGGGAAATTCACAGGACAAAAACCTGGTTTTCTTTTTTGGTTTCTTCAACC AAAAAAGAAAGAAATTGCAAAGGACCAAAAAAATGTTGGGGAATCTATACATTATAAGGGA CTTAACAACTAAAGGGCAACATATAGACTTTAGATCCTAATTTGAGCAAAATCTAAAATCAATT ATTAGGCAATCAGAAAAATTGAACACAGACTAGATATTTGAGGATATTAAGGTACTATATTA TTGAAGATTCCATGGTTATGTTTTTTAAAGAGTTCATGCCTTTTAGAGATACATACTAAAGTAT TTGTAAATAAATGACATGATCTAGAATCAGTAATTTTGTGTTTGGGGTGTGGGGGTGGTGAA AGGGAAGTAGAACCGAAACAAGATTAGTCCTGAGTTAACAATGGCTGCAAGCTGGATACATG GAATTC |
| 1768 | SAMD9 | 3061440 | CTGGGATTTTCCATTGGAGGCCCACTTGCTTATGACA |
| 1769 | SAMD9 | 3061441 | GCTCTTTTGGATTTAGCAGAACATGCCTCAAGTGCATTCAAAGAATCTCAACAGCAAAGTGAA GATAGAGAGTATGAAGTGAAGGAAAGATTGTATCCGAAGTCAAAAAGGCGGTATGATACTT ACAATATAGCTGGTTATCAAGGAGAGATAGAAGTTGGGCTTTACACAATCCAAATTCTCCAGC TCATTCCTTTTTTTGATAATAAAAATGAGCTATCTAAAAGATATATGGTCAATTTTGTATCAGG AAGTAGTGATATTCAGGGGATCCAAACAATGAATATAAATTAGCCCTCAAAACTATATTCC TTATTTAACTAAATTGAAATTTCTTTGAAAAAGTCCTTTGATTTTTTTGATGAATACTTTGTCCT GCTAAAACCCAGGAACAATATTAAGCAAAATGAAGAGGCCAAAACTCGGAGAAAGGTGGCT GGATATTTTAAGAAATATGTAGATATATTTTGTCTCTTAGAAGAATCACAAAACAACACAGGT |

TABLE 13-continued

Subtyping Target Sequences

| SEQ ID NO. | Gene | Affy Probeset ID | Sequence |
| --- | --- | --- | --- |
| | | | CTTGGATCAAAGTTCAGTGAGCCACTTCAAGTAGAGAGATGCAGGAGAAACCTAGTAGCTTT<br>AAAAGCAGACAAGTTTTCTGGGCTCTTGGAATATCTTATCAAAAGTCAAGAGGATGCTATAAG<br>CACTATGAAATGTATAGTGAACGAATATACTTTTCTCTTAGAACAATGCACTGTCAAAATCCAG<br>TCAAAAGAAAAGCTAAATTTCATCTTGGCCAACATTATTCTCTCCTGTATCCAACCTACCTCCA<br>GATTAGTAAAGCCAGTTGAAAAACTAAAAGATCAGCTTCGAGAAGTCTTGCAACCAATAGGA<br>CTGACTTATCAGTTTTCAGAACCGTATTTTCTAGCTTCCCTCTTATTCTGGCCAGAAAATCAACA<br>ACTAGATCAACATTCTGAACAAATGAAAGAGTATGCTCAAGCACTAAAAAATTCTTTCAAGGG<br>GCAATATAAACATATGCATCGTACAAAGCAACCAATTGCATATTTCTTTCTTGGAAAAGGTAA<br>AAGACTGGAAAGACTTGTTCACAAAGGAAAAATTGACCAGTGCTTTAAGAAGACACCAGATA<br>TTAATTCCTTGTGGCAGAGTGGAGATGTGTGGAAGGAGGAAAAAGTCCAAGAACTTTTGCTT<br>CGTTTACAAGGTCGAGCTGAAA |
| 1770 | SAMD9 | 3061442 | CAGAGGTCATCGAATGTGGGAACTACTGTGGAGTACGCATCATTCACTCTTTGATTGCAGAGT<br>TCTCACTGGAAGAATTGAAGAAAAGCTATCACCTGAATAAAAGTCAAATTATGTTGGATATGC<br>TAACTGAGAATTTGTTCTTCGATACTGGTATGGGAAAAAGTAAATTTTTGCAAGATATGCACA<br>CACTCCTACTCACAAGACACCGCGATGAACATGAAGGTGAAACAGGAAATTGGTTTTCCCCAT<br>TTATTGAAGCATTACATAAAGATGAAGGAAATGAAGCAGTTGAAGCTGTATTGCTTGAAAGT<br>ATCCATCGGTTCAACCCAAATGCATTCATTTGCCAAGCGTTGGCAAGACATTTCTACATTAAAA<br>AGAAGGACTTTGGCAATGCTCTAAACTGGGCA |
| 1771 | SAMD9 | 3061443 | AAGGATCCCAGACAGTATTGCCGTAATACAGCAACTCTCTCCCAAAGAACAGAGAGCTTTTGA<br>GCTTAAATTGAAAGAAATCAAAGAACAGCATAAAAACTTTGAGGATTTTTATTCCTTTATGATC<br>ATGAAAACCAATTTTAATAAAGAATACATAGAAAATGTGGTCCGGAATATCCTGAAAGGGCA<br>GAATATTTTCACCAAGGAAGCAAAGCTCTTTTCTTTTCTGGCTCTTCTTAATTCATATGTGCCTG |
| 1772 | SAMD9 | 3061444 | CCTTGGCTATGCACATTCTCTGGGAACTAAGGAAGAAATTCAGATGTGCTGTGCTGAAAAACA<br>AGACAGTGGATTTTTCTGAAATTGGAGAACAGGTAACCAGTTTAATCACCTATGGGGCAATG<br>AACCGTCAGGAATACGTACCTGTACTACTCCTTGTTGATGA |
| 1773 | SAMD9 | 3061445 | AAAACTGTGCAGATTCTTCTAAACCAACAAGTACCAAAATTATTCATC |
| 1774 | SAMD9 | 3061446 | AGGAAGACTTCTATCGAGGTGGCAAAGTGTCATGGTGGAACTTCTACTTCTCTTCTGAAAGTT<br>ATTCTTCACC |
| 1775 | SAMD9 | 3061447 | GCACCCACACATATTTCAGGGATGGAAAGATCTACTTGAAGCAAGATTAATAAAACACCAAG<br>ATGAAATTTCAAGCCAATGTATTTCTGCTTTAAGCCTTGAAGAGATCAATGGCACTATTCTTAA<br>ACTAAAATCTGTGACTCAATCTTCAAAAAGGCTTTTGCCATCTATTGGTTTATCGACTGTCCTTC<br>TGA |
| 1776 | SAMD9 | 3061448 | AGCCGAGTAGCAAACCTTCACTTTCCAAGTGTATATGTAGAACAGAAAACCACACCAAATGAG<br>ACGATTTCTACTCTAAATCTTTACCATCAACCCAGCTGGATTTTCTGCAATGGCAGGTTAGACC<br>TTGACAGTGAAAATATAAACCCTTTGATCCAAGTTCCTGGCAAAGAGAAAGAGCTTCTGATG<br>TCAGGAAACTGATTTCATTTCTTACACATGAAGACATAATGCCAAGAGGGAAGTTTTTGGTGG<br>TATTTCTATTACTGTCCTCTGTGGATGACCCAAGAGATCCCCTCATTGAGACTTTCTGTGCTTTC<br>TACCAGGATCTCAAAGGAATG |
| 1777 | SAMD9 | 3061449 | TTCTCTGAATGCCAATATGATTATTTCCAGATTAAAATGCAAAATTACAACAACAAAATATGGG<br>AACAAAGTAAAAAATTCTCACTATTTGTGCGAGATGGGACCAGCTCTAAGGACATTACGAAA<br>AATAAAGTTGATTTCAGAGCATTTAAAGCAGATT |
| 1778 | SAMD9 | 3061450 | GGCAATCTCATTGATCCGATACATGAATTCAAAGCCTTCACAAATACAGCAACAGCCACAGAA<br>GAGGATGTCAAGATGAAATTTAGCAATGAGGTTTTCCGATTTGCTTCAGCTTGTATGAATTCA<br>CGTACCAATGGCACTATTCATTTTGGAGTCAAAGACAAACCCCATGGGAAAATTGTTGGCATC<br>AAAGTCACCAATGATACCAAGGAAGCCCTCATTAACCATTTCAATCTGATGATAAACAAGTAT<br>TTTGAAGACCATCAAGTCCAACAAGCAAAGAAGTGCATTCGAGAGCCAAGATTTGTG |
| 1779 | SAMD9 | 3061451 | TTGATATGGGCATCACACATGGACCAGCTATTCAAATAGAAGAACTATTCAAAGAATTGCGGA<br>AAACAGCCATTGAAGATTCGATTCAGACATCTAAGATGGGAAAGCCCAGTAAAAATGCTCCT<br>AAAGACCCAAACTGTGTCTCAAAAGGAACGTAGAGAAACTTCAAAGCAAAAACAAAAGGGTA<br>AAGAGAACCCAGATATGGCTAATCCGTCTGCAATGAGTACAACTGCTAAAGGTTCTAAGTCAC<br>TAAAAGTTGAGCTCATAGAAGATAAAATAGATTATACAAAGGAAAGGCAACCATCCATAGAC<br>CTGACATGTGTATCATATCCATTTGATGAATTCAGTAATCCATATCGTTACAAGTTGGATTTTA<br>GTCTACAGCC |
| 1780 | SAMD9 | 3061452 | GAATAGGTGGCCTTTTGTGATCTCCTACATCACCCTGGAAGTGAGACTTCTTCGGTTTCTTCTA<br>GAGTC |
| 1781 | SAMD9 | 3061453 | TACTTTTCTCTAGCATCGTAGGAGGAAGAAAACAAACACATCAGATATTTTCAGCACTAAAAG<br>AGATGGTTTTCCCCACATATA |
| 1782 | PTN | 3074858 | GAAATTATTTTCCATCTGAGGAAAAAAATACTAGGAAAATAAATCAAGGTGATGCTG |
| 1783 | PTN | 3074859 | GGAAGCAGAGCATGTCCTAGTTCAATGTT |

TABLE 13-continued

Subtyping Target Sequences

| SEQ ID NO. | Gene | Affy Probeset ID | Sequence |
|---|---|---|---|
| 1784 | PTN | 3074860 | ATGTCACCTGTGGAACATAAAAAGGACATCAGCAAACAGGATCAGTTAACTATTGCATTTATA<br>TGTACCGTAGGCTTTGTATTCAAAAATTATCTATAGCTAAGTACACAATAAGCAAAAACAAAA<br>AGAAAAGAAAATTTTTGTAGTAGCGTTTTTTAAATGTATACTATAGTACCAGTAGGGGCTTAT<br>AATAAAGGACTGTAATCTTATTTAGGAAGTTGACTTATAGTACATGATAAATGATAGACAATT<br>GAGGTAAGTTTTTTGAAATTATGTGACATTTTACATTAAATTTTTTTACATTTTTTGGGCAGCA<br>ATTTAAATGTTATG |
| 1785 | PTN | 3074861 | AAAGGAAGGCAAGAAACAGGAGAAGATGCTGGATTA |
| 1786 | PTN | 3074862 | ATGGATTCGTCTACTGATGCAACTG |
| 1787 | PTN | 3074863 | AAGATGGTAGAGAGGAGTGTTTGGGTG |
| 1788 | PTN | 3074872 | CCAGTTCCAGGCCTGGGGAGAATGTGACCTGAACACAGCCCTGAAGACCAGAACTGGAAGTC<br>TGAAGCGAGCCCTGCACAATGCCGAATGCCAGAAGACTGTCACCATCTCCAAGCCCTGTGGC<br>AAACTGACCAAGCCCAAACC |
| 1789 | PTN | 3074873 | GTGTGTGCCCACCAGTGGAGACTGTGGGCTGGGCACACGGGAGGGCACTCGGACTGGAGCT<br>GAGTGCAAGCAAACCATGAAGACCCAGAGATGTAAGATCCCCTGCAA |
| 1790 | PTN | 3074874 | TGCAGGCTCAACAGTACCAGCAGCAGCGTCGAAAATTTGCAGCTGCCTTCTTGGCATTCATTT<br>TCATACTGGCAGCTGTGGA |
| 1791 | PTN | 3074901 | AGTGAGTCATCCGTCCAGAAGGCGGGGAGAGCAGCAGCGGCCCAAGCAGGAGCTGCAGCG<br>AGCCGGGTACCTGGACTCAGCGGTAGCAACCTCGCCCCTTGCAACAAAGGCAGACTGAGCGC<br>CAGAGAGGACGTTTC |
| 1792 | PTN | 3074902 | TTGAGTCAAAGGCAGGATCAGGTTCCCCGCCTTCCAG |
| 1793 | KRT8 | 3100564 | CCTTCTAGGATCTCCGCCTGGTTCGGCCCGCC |
| 1794 | SULF1 | 3102371 | CATCAGCATTCTACCAGCTGTGAAAGTGTTTGAGCACACGGGATATCCCTTCCAG |
| 1795 | SULF1 | 3102373 | CTCAGCCTCCAATCCGTAAGAGACACCCAGCCCCAGCAATTGGATTGGGCAGCCCGTCTTGAC<br>ACACCACTGTGCTGAGTGCTTGAGGACGTGTTTCAACAGATGGTTGGGGTTAGTGTGTGTCAT<br>CACATTCGAGTGGGGATTAAGAGAAGGAAGGCTGCCTTGCTGGAGCTGTGTGGTCTTCTCCA<br>AGTGAGAGTCGCAGGCA |
| 1796 | SULF1 | 3102380 | TGACTCTCCCCCTTCGGAGGAGGAAGGAAGTCCCGCTGCCACCTTATCTCTGCTCCTCTGCCTC<br>CTCCCTGTTCCCAGAGCTTTTTCTCTAGAAGATTTTGAAGGCGGCTTT |
| 1797 | SULF1 | 3102381 | TCTTCACTTCTCTTGAACAAGGAACTCACTCAGAGACTAACACAAAGGAAGTAATTTCTTACCT<br>GGTCATTATTTAGTCTACAATAAGTTCATCCTTCTTCAGTGTGACCAGTAAATTCTTCCCATACT<br>CTTGAAGAGAGCATAA |
| 1798 | SULF1 | 3102386 | ACGGCCACCCACCATCATCTAAAGAAGATAAACTTGGCAAATGACATGCAGGTTCTTCA |
| 1799 | SULF1 | 3102391 | TCTGCAGATGTTCTGAATACCTCTGAGAATAGAGATTGATTATTCAACCAGGATACCTAATTCA<br>AG |
| 1800 | SULF1 | 3102392 | TTGTCAGTTTTGCAACATTGGACCAAA |
| 1801 | SULF1 | 3102393 | GGGAAGCCTCTGTTCGACTGTCAGATCCCCGAGGTTCAGAGGACGGATACAGCAGGAACGA<br>AAAAACATCCGACCCAACATTATTCTTGTGCTTACCGATGATCAAGATG |
| 1802 | SULF1 | 3102404 | GCTACATCCCCCCTGGGTGGCGAGAATGGCTTGGATTAATCAAGAATTCTCGCTTCTATAATT<br>ACACTGTTTGTCGCAATGGCATC |
| 1803 | SULF1 | 3102405 | TACTTCACAGACTTAATCACTAACGAGAGCATTAATTACTTCAAAATGTCTAAGAGAATGTATC<br>CCCATAGGCCCGTTATGATGGTGATCAGCCACGCTGCGCCCACGGCCCCGAGGACTCAGCC<br>CCACAGTTTTCTAAACTGTACCCCAATGCTTCC |
| 1804 | SULF1 | 3102407 | AACAGACAGGGTAAGGACCAATCTGGACTGTGTTATCTTTT |
| 1805 | SULF1 | 3102410 | AACTCCTAGTTATAACTATGCACCAAAT |
| 1806 | SULF1 | 3102411 | AGGACCAATGCTGCCCATCCACATGGAATTTACAAACATTCTACAGCGCAAAAGGCTCCAGAC<br>TTTGATGTCAGTGGATGATTC |
| 1807 | SULF1 | 3102412 | CTGTATAACATGCTCGTGGAGACGGGGAGCTGGAGAATACTTACATCATTTACACCGCCGA<br>CCATGGTTACCATATTGGGCAGTTTGGACTGGTCAAGGGGAAATCCATGCCA |
| 1808 | SULF1 | 3102414 | GTCCCACAGATCGTTCTCAACATTGACTTGGCCCCCACGATCCTGGATATTGCTGGGCTCGAC<br>ACACCTCCTGATGTGGACGGCAAGTCTG |

TABLE 13-continued

Subtyping Target Sequences

| SEQ ID NO. | Gene | Affy Probeset ID | Sequence |
|---|---|---|---|
| 1809 | SULF1 | 3102417 | AAGAAGGCCAAAATTTGGCGTGATACATTCCTAGTG |
| 1810 | SULF1 | 3102419 | TTTCTACGTAAGAAGGAAGAATCCAGCAAGAATATCCAACAG |
| 1811 | SULF1 | 3102430 | GCAATGCATTGAGGATACATCTGGCAAGCTTCGAATTCACAAGT |
| 1812 | SULF1 | 3102431 | GTCCGGCAGAGCACGCGGAACCTCTACGCTCGCGGCTTCCATGACAAAGACAAAGAGTGCAGTTGTAGGGAGTCTGGTTACCGTGCCAGCAGAAGCCAAAGAAAGAGTCAACGGCAATTCTTGAGAAACCA |
| 1813 | SULF1 | 3102434 | TCCATACTCGGCAGACACGTTCCTTGTCCGTCGAATTTGAAGGTGAAATATATGACATAAATCTGGAAGAAGAAGAAGAATTGCAAGTGTTGCAACCAAGAAACATTGCTAAGCGTCATGATGAAGGCCACAAGGGGCCAAGAGATCTCCAGGCTTCCAGTGGTGGCAACAGGGGCAGGATGCTGGCAGATAGCAGCAACGCCGTGGGCCCA |
| 1814 | SULF1 | 3102435 | ATGACTCTATCCATTGTGAGAGAGAACTGTACCAATCGGCCAGAGCGTGGAAGGACCATAAGGCATACATTGACAAA |
| 1815 | SULF1 | 3102437 | ATTGAAGCTCTGCAAGATAAAATTAAGAATTTAAGAGAAGTGAGAGGACATCTGAAGAGAAGGAAGCCTGAGGAATGTAGCTGCAGTAAACAA |
| 1816 | SULF1 | 3102439 | GCTCAGGAAGTAGATAGCAAACTGCAACTTTTCAAGGAGAACAACCGTAGGAGGAAGAAGGAGAGGAAGGAGAAGAGACGGCAGAGGAAGGGGGAAGAGTGCAGCCTGCCTGGCCTCACTTGCTTCACGCATGACAACAACCACTGGCAGACAGCC |
| 1817 | SULF1 | 3102442 | TCTACAAGTTAACCAGAGGGCTATGTGGTATAAAAGATGTTTGTGGTCACAGCCTAGCTCAGGCTAGAGTGTTGCAGAGACCATCCCAAATCCTCCAGGCTGGGCTCAAGGCTTCTCTAAACCCTTCTTTGTTGCAAAATCCCATCTTTTCATGCTTCATTGGTGACATGTGGCCATCTGCCACATAGAACAAGTGAGAGTACTAGTTCCATATCTTTATTAAATAACCATTTTTCTTTTGTACAAAGAATAAATAGAAATTCTGATATTTTTCTTCTCATACTTCCGTCACTCACCCCTCTTTGGAAACCACTGCATAACAGAGCTAAGGGGAGGATAAACTAATGTGCTGAAATTTTACTTTAGTCTTCAGCCTATAAGAGATCACTATCTTTTTTCCCATTTTCACCTAGTTTCACAGCAAATTTACCTACGGGGGGAAAGGTATTATTATTCTTAACATGAAACCACAATATTTATAAGAAAGAAATTGTGAACTTTAAAGTGTAAAGATAAGGGAACACTGGAATGGCAAGCCTGCCTAAGGTTTTTCA |
| 1818 | SULF1 | 3102443 | GAGTTCTAACAATAACACCTACTGGTGTTTGCGTACAGTTAATGAGACGCATAATTTTCTTTTCTGTGAGTTTGCTACTGGCTTTTTGGAGT |
| 1819 | SULF1 | 3102445 | CACACGGTAGAACGAGGCATTTTGAATCAGCTACACGTACAACTAATGGAGCTCAGAAGCTGTCAAGGATATAAGCAGTGCAACCCAAGACCTAAGAATCTT |
| 1820 | SULF1 | 3102447 | GAAATAAAGATGGAGGAAGCTATGACCTA |
| 1821 | SULF1 | 3102450 | AATGTTGCTGTTCCTGGTACCCTGTTCGGCCCCTCTAACCTCCAGAGCTATGGTCTCAGATGCTTCCTTT |
| 1822 | SULF1 | 3102451 | GAGAAGGTCATTAGTCCACCAAGAAGCC |
| 1823 | SULF1 | 3102460 | AGGACAGTTATGGGATGGATGGGAAGGTTAA |
| 1824 | SULF1 | 3102461 | TTGCACTGCTGAAGAGTCACTATGAGCAAAATAAAACAAATAAGACTCAAACTGCTCAAAGTGACGGGTTCTTGGTTGTCTCTGCTGAGCACGCTGTGTCAATGGAGATGGCCTCTGCTGACTCAGATGAAGACCCAAGGCATAAGGTTGGGAAAACACCTCATTTGACCTTGCCAGCTGACCTTCAAACCCTGCATTTGAACCGACCAACATTAAGTCCAGAGAGTAAACTTGAATGGAATAACGACATTCCAGAAGTTAATCATTTGAATTCTGAACACTGGAGAAAAACCGAAAATGGACGGGGCATGAAGAGACTAATCATCTGGAAACGATTTCAGTGGCGATGGCATGACAGAGCTAGAGCTCGGGCCCAGCCCCAGGCTGCAGCCCATTCGCAGGCACCCGAAAGAACTTCCCCAGTATGGTGGTCCTGGAAAGGACATTTTTGAAGATCAACTATATCTTCCTGTGCATTCCGATGGAATTTCAGTTCATCAGATGTTCACCATGGCCACCGCAGAACACCGAAGTA |
| 1825 | SULF1 | 3102462 | ACTAATAAAGGTAATCACAGCCACCAA |
| 1826 | SULF1 | 3102463 | CCCTGGGTACCTTTGTGCAGTAGAAGCTAGTGAGCATGTGAGCAAGCGGTGTGCACACGGAGACTCATCGTTATAATTTACTATCTGCCAAGAGTAGAAAGAAAGGCTGGGGATATTTGGGTTGGCTTGGTTTTGATTTTTTGCTTGTTTGTTTGTTTTGTACTAAAACAGTATTATCTTTTGAATATCGTAGGGACATAAGTATATACATGTTATCCAATCAAGATGGCTAGAATGGTGCCTTTCTGAGTGTCTAAAACTTGACACCCCTGGTAAATCTTTCAACACACTTCCACTGCCTGCGTAATGAAGTTTTGATTCATTTTTAACCACTGGAATTTTTCAATGCCGTCATTTTCAGTTAGATGATTTTGCACTTTGAGATTAAAATGCCATGTCTATTTGATTAGTCTTATTTTTTATTTTTACAGGCTTATCAGTCTCACTGTTGGCTGTCATTGTGACAAAGTCAAATAAACCCCAAGGACGACACACAGTATGGATCACATATTGTTTGACATTAAGCTTTTGCCAGAAAATGTTGCATGTGTTTTACCTCGACTTGCTAA |

TABLE 13-continued

Subtyping Target Sequences

| SEQ ID NO. | Gene | Affy Probeset ID | Sequence |
|---|---|---|---|
| 1827 | SULF1 | 3102464 | GTGCCTAGCCTCAAAGCGTTCATCATACATCATACCTTTAAGATTGCTATATTTTGGGTTATTTT<br>CTTGACAGGAGAAAAAGATCTAAAGATCTTTTATTTTCATCTTTTTTGGTTTTCTTGGCATGACT<br>AAGAAGCTTAAATGTTGATAAAATATGACTAGTTTTGAATTTACACCAAGAACTTCTCAATAAA<br>AGAAAATCATGAATGCTCCACAATTTCAACATACCACAAGAGAAGTTAATTTCTTAACATTGTG<br>TTCTATGATTATTTGTAAGACCTTCACCAAGTTCTGATATCTTTTAAAGACATAGTTCAAAATTG<br>CTTTTGAAAATCTGTATTCTTGAAAATATCCTTGTTGTGTATTAGGTTTTTAAATACCAGCTAAA<br>GGATTACCTCACTGAGTCATCAGTACCCTCCTATTCAGCTCCCCAAGATGATGTGTTTTTGCTT<br>ACCCTAAGAGAGGTTTTCTTCTTATTTTTAGATAATTCAAGTGCTTAGATAAATTATGTTTTCTT<br>TAAGTGTTTATGGTAAACTCTTTTAAAGAAAATTTAATATGTTATAGCTGAATCTTTTTGGTAA<br>CTTTAAATCTTTATCATAGACTCTGTACATATGTTCAAATTAGCTGCTTGCCTGATGTGTGTATC<br>ATCGGTGGGATGACAGAACAAAC |
| 1828 | SULF1 | 3102465 | TTAGGAAGCATACTCTGTTTTTTAATCATGTATAATATTCCATGATACTTTTATAGAACAATTCT<br>GGCTTCA |
| 1829 | PSCA | 3119201 | ATCAGCCCAGGACGGTCTTCCCGGTGCAGTTTCTGATGCGGGAGGGCAGTGCTGCCTTCCG<br>GTCACCAGGACCAGTGCTCAGCCCGCTGCTTGACCCCCTTACTTAGCTGGGGTCCAATCCA |
| 1830 | PSCA | 3119206 | GGCTGTGCTGCTTGCCCTGTTGATGGCAGGCTTGGCCCTGCAGC |
| 1831 | PSCA | 3119207 | CCCTGCTGTGCTACTCCTGCAAAGCCCAGGTGAGCAACGAGGACTGCCTGCAGGT |
| 1832 | PSCA | 3119208 | CTTTCTGGCCATCTGTCCGCATCTGTGTGCTGTTTTCCTTCCACCTGTCCCGACCCGTCCCGCA<br>CCTGCACCCCCAACAATCACCCAGCATCTGTCCCTCCAGCCATCCTCCTCCATCTGCCACTCCTC<br>CACTCATCTGTCCCTCCCCATCCTCCATCTTCCACTCCTCCACCCATCTGTCCCTCCCCATCCCTG<br>AGCTCACTTACTCACTCACCCCATTTCTGACGCTCAGCGGGTGGTCCATCTGCCTCGGACATCT<br>GGATAGGGCTGAGACCAGGGCCGAGACCAGGCCCTCGCACTGCTTGCAATCCTGAGGCCA |
| 1833 | PSCA | 3119209 | AGCTTGAACTGCGTGGATGACTCACAGGACTACTACGTGGGCAAGAAGAACATCACGTGCTG<br>TGACACCGACTTGTGCAACGCCAGCGGGGCCCAT |
| 1834 | PSCA | 3119210 | GAGGCACATCCTAACGCAAGTCTGACCATGTATGTCTGCGCCCCTGTCCCCCACCCTGACCCTC<br>CCATGGCCCTCTCCAGGACTCCCACCCGGCAGATCGGCTCTATTGACACAGATCCGCCTGCAG<br>ATGGCCCCTCCAACCCTCTCTGCTGCTGTTTCCATGGCCCAGCATTCTCCACCCTTAACCCTGTG<br>CTCAGGCACCTCTTCCCCCAGGAAGCCTTCCCTGCCCACCCCATCTATGACTTGAGCCAGGTCT<br>GGTCCGTGGTGTCCCCCGCACCCAGCAGGGGACAGGCACTCAGGAGGGCCCGGTAAAGGCT<br>GAGATGAAGTGGACTGAGTAGAACTGGAGGACAGGAGTCGACGTGAGTTCCTGGGAGTCTC<br>CAGAGATGGGGCCTGGAGGCCTGGAGGAAGGGGCCAGGCCTCACATTCGTGGGGCTCCCTG<br>AATGGCAGCCTCAGCACAGCGTAGGCCCCTTAATA |
| 1835 | SNAI2 | 3134549 | TCCTGTGCTGACCAACCAAATAATATGTATAGACACACACACATATGCACACACACACACACA<br>CACCCACAGAGAGAGAGCTGCAAGAGCATGGAATTCATGTGTTTAAAGATAATCCTTTCCATG<br>TGAAGTTTAAAATTACTATATATTTGCTGATGGCTAGATTGAGAGAATAAAAGACAGTAACCT<br>TTCTCTTCAAAGATAAAATGAAAAGCACATTGCATCTTTTCTTCCTAAAAAAATGCAAAGATTT<br>ACATTGCTGCCAAATCATTTCAACTGAAAAGAACAGTATTGCTTTGTAATAGAGTCTGTAATA<br>GGATTTCCCATAGGAAGAGATCTGCCAGACGCGAACTCAGGTGCCTTAAAAAGTATTCCAAG<br>TTTACTCCATTACATGTCGGTTGTCTGGTTGCCATTGTTGAACTAAAGCCTTTTTTTGATTACCT<br>GTAGTGCTTTAAAGTATATTTTTAAAAGGGAGGAAAAAAATAACAAGAACAAAACACAGGAG<br>AATGTATTAAAAGTATTTTTGTTTTGTTTTGTTTTTGCCAATTAACAGTATGTGCCTTGGGGGA<br>GGAGGGAAAGATTAGCTTTGAACATTCCTGGCGCATG |
| 1836 | SNAI2 | 3134550 | TTTCTTGCCCTCACTGCAACAGAGCATTTGCAGACAGGTCAAATCTGAGGGCTCATCTGCAGA<br>CCCATTCTGATGTAAAGAAATACCAGTGCAAAAACTGCTCCAAAACCTTCTCCAGAATGTCTCT<br>CCTGCACAAACATGAGG |
| 1837 | SNAI2 | 3134552 | TGCGATGCCCAGTCTAGAAAATCTTTCAGCTGTAAATACTGTGACAAGGAATATGTGAGCCTG<br>GGCGCCCTGAAGATGCATATTCGGACCCACACATTACCTTGTGTTTGCAAGATCTGCGGCAAG<br>GCGTTTTCCAGACCCTGGTTGCTTCAAGGACA |
| 1838 | SNAI2 | 3134553 | TGAGAGTTACTCCATGCCTGTCATACCACAACCAGAGATCCTCAGCTCAGGAGCATACAGCCC<br>CATCACTGTGTGGACTACCGCTGCTCCATTCCACGCCCAGCTACCCAATGGCCTCTCTCCTCTTT<br>CCGGATACTCCTCATCTTTGGGGCGAGTGAGTCCCCCTCCTCCATCTGACACCTCCTCCAAGGA<br>CCACAGTGGCTCAGAAAAGCCCCATTAGTGATGAAGAGGAAAGACTACAGTCCAAGCTTTCAG<br>ACCCCCATGCCATTGAAGCTGAAAAGTT |
| 1839 | SNAI2 | 3134554 | CAAGAAGCATTTCAACGCCTCCAAAAAGCCAAACTACAGCGAACTGGACACACATACAG |
| 1840 | SNAI2 | 3134555 | TCCCAGCCAAAACGGGCTCAGTTCGTAAAGGAGCCGGGTGACTTCAGAGGCGCCGGCCCGTC<br>CGTCTGCCGCACCTGAGCACGGCCCCTGCCCGAGCCTGGCCCGCCGCGATGCTGTAGGGACC<br>GCCGTGTCCTC |
| 1841 | SNAI2 | 3134557 | TCCTGCGCCCCTCCTAGCTCCCAGAGAGCGTGGATCGCGGGCGGGGCTCACCGAGCGAG |

TABLE 13-continued

Subtyping Target Sequences

| SEQ ID NO. | Gene | Affy Probeset ID | Sequence |
|---|---|---|---|
| 1842 | SNX31 | 3146725 | TCAGGTGGGCTACCTACCATCAGTGGAGGAAATTTGACCTCTTCCCATTTTTTTGGCATTAACA TGGACTGTATTCATCAAGGTATTATACCACAGCACTCTATGGAAATCTCAAGATTAGAAAAAA AAAAAGAACCAAGTTATAGAGTTAGTTTTTATTTTATTTTTGCACTTCGTCATGACAGTATAGA GTTTGTTTTTAATGTCTCATAAATGACAAGTGGCAAATTCAAATCAACTCATATAAAACTCATT CTATTTTTTCTCTAAAATAGATCTTTATATGGCTTCATGAAGTCTTTTATGTGTTTTGAATTTACA TAAATGAAAGTCTCATAAAATATCATAAAGATATTTTGGATCGATTTCTAAAGATGTGACTCTT CAACGGAGGAGAATAGGGCTCTGAGAAATGGAATCACTGAAAAAGAAACCTGGGTTCTCTG ATCTATCCACACAGAACTAGAGCAAGGAGGTGATGAAATACTGATCTCTTTCCTCACATAAGT CTGAGCCTACCAATATGGATGTACTCAAAGTGAAACGCTGCCCTGTTCTCTGCTTGACCATTGT TA |
| 1843 | SNX31 | 3146726 | AGACTATTCTAGTTTTCTATCAAGAAAAAGCAAGATTAAGATAGCTAAAGATGACTGCGTTTT TGGGAACATAAAG |
| 1844 | SNX31 | 3146729 | TGGTGACTGAACAATTCAAGATGTGCTAGAGAGTAGTAAATCAAAGCAATAAAAGAATCAAG GAAACTCTTTTTAAAAGAGTAATATAATAAAATCCAACCTCTCAGGCAGGATGGACCCTCTTA GGCTGAGATTA |
| 1845 | SNX31 | 3146732 | GAACTCTGCTGGATACGGATGGGCCCCAGAGAACTCTCAACCAGAACTTAGAGCTCAGATTT CAATACAGTGAGGATAGTTGC |
| 1846 | SNX31 | 3146736 | CGGGAGGTACGGCACTATGGATACCTGCAGCTGGATCCTTGTACCTGTGACTACCCAGAATC AGGCTCTGGAGC |
| 1847 | SNX31 | 3146741 | CATCCCTCGACTCCGTGCTGATGGACTGCAGGGTGGCGGTAGATTTGCTCTACATGCAG |
| 1848 | SNX31 | 3146743 | ACTTTGAACTCCCTTATGTTAGTCTTGGAAGTTCTGAGGTG |
| 1849 | SNX31 | 3146744 | GTGTCACACAAAATTGGACTGTGTCGAGAGCTCTTGGGCTACTTCGGCCTCTTTCTCATTCGGT TTGGCAAGGAGG |
| 1850 | SNX31 | 3146749 | ATTTGACATCGCCACCAAGAAAGCTTATCTGGACATATTTCTGCCCAATGAACAGAGTATTAG AATCGAAATTATAACATCAGACACTGC |
| 1851 | SNX31 | 3146750 | AAAAATCAGGGATATGGGCTTTAGGG |
| 1852 | SNX31 | 3146759 | ATGGACCCAAACGTGTTGAGAAGTGATGTCTTCGTTGAGTTTTAA |
| 1853 | SNX31 | 3146761 | CTTCCCACCAAAGTACTATCTGGCAATGACCACAGCTATGGCTGATGAGAGGAGGGACCAAC TGGAACAATATTTG |
| 1854 | SNX31 | 3146764 | TGCATTTCTGTATCCCGGTGTCCCAGCAGCGGTCCGACGCGCTGGGGGGCCG |
| 1855 | SNX31 | 3146765 | TTCGCTCTGAGTCGCGTGGCAGGCCGCGCTGCGTCCACCGCTGCCGAGTTCAGAGCCGCGCA CCGCCCGCCGCCGCAGGTCGGGTTCCCAGCGCTACTCCCAAGAC |
| 1856 | SNX31 | 3146767 | CTCCCAAGTAGTCCACTTCATTCTTCACCTCTGGA |
| 1857 | SNX31 | 3146768 | CCAGTTGTACTGTCGAGAAAAGAGCTATTTCTGTCTTTTAACTCTCAAATACAAAGATACTGCT CAGTGGGAATCAAACATTCCTAATTTTCATTTATTTATCTTTTCATTTTAATTTTGGATTGGGGG GGGTATCTGCGCAGCTCTGTTAGACGGAGTATATTGCATGGTGCTGAGGTCTGGGCTTCTGA TGGTCCCGTCGTTCAAGTAGCAAACGCGCTGCGCGA |
| 1858 | PABPC1 | 3146782 | TGACACCGCCATGAAAACGATCAGCACCGTCGAATCCTCACGCCCCACTCAAGTTCCTTGATT GCTTCAATAATGTCCTCCGTAGCAAAAGGATCTAGTTCAAAATCGGGAGTTACATTTCATTGTC ATGCCTAAAACGTAAGAATTGCTCATTCACTTTGGAGCAGTTCTTCAGTCTATCCTTGATTTTC ATGACCTTGACACTTTTGAACATTATAGACCAGTTATTCAATAGAAATATCTTTCAATCTGGGTT TGTCCGATACCTCTTTATTATTAGATTGAAATGACATTTTGGTGGAACTATCACAGAATTGA CATTGCATTCTTCTCATTACATCCTGTCTGGTGGCCTG |
| 1859 | PABPC1 | 3146788 | CCTTATGTACCGAGCAAATGCCAGGTCTAGCAAACATAATGCTAGTCCTAGATTACTTATTGAT TTAAAAACAAAAAAACACAAAAAAATAGTAAAATATAAAAACAAATTAATGTTTTATAGACCC TGGGAAAAAGAATTTTCAGCAAGTACAAAAATTTAAAGCATTCCTTTCTTTAATTTTGTAATT CTTTACTGTGGAATAGCTCAGAA |
| 1860 | PABPC1 | 3146789 | TGATCAGGGACCATGAAAAGAAACTTGTGCTTCACCGAAGAAAAATATCTAAACATCGAAAA ACTTAAATATTATGG |
| 1861 | PABPC1 | 3146791 | ATGAAGCTGTAGCTGTACTACAAGCCCACCAAGCTAAAGAGGCTGCCCAGAAAGCAGTTAAC AGTGCCACCGGTGTTCCAACTGTTT |
| 1862 | PABPC1 | 3146793 | GCCATGCACCCTACTCTTGCTGGTA |
| 1863 | PABPC1 | 3146794 | TCCTCAAGAGCAAAAGCAAATGTTG |

TABLE 13-continued

Subtyping Target Sequences

| SEQ ID NO. | Gene | Affy Probeset ID | Sequence |
|---|---|---|---|
| 1864 | PABPC1 | 3146795 | AATGGGTCCACGTCCTGCAGCTGCA |
| 1865 | PABPC1 | 3146797 | TGCAAACCTCAGATCGAAGAAGACAGCATAAACACTTTTCACTCAGTAAGTTTTCCCAGTTAATGTA |
| 1866 | PABPC1 | 3146799 | AACCGTGCTGCATACTATCCTCCTA |
| 1867 | PABPC1 | 3146802 | TTATGATGGAGGGTGGTCGCAGCAAA |
| 1868 | PABPC1 | 3146805 | GATGATGGTATTGATGATGAACGTCTCCGGAAAGAGTTTTCTCCAT |
| 1869 | PABPC1 | 3146806 | TTATGTTGGTCGAGCTCAGAAAAAGGTGGAACGGCAGACGGAACTTAAGCGCAAATTTGAACAGATGAAACAAGATAGGATCACCAGAT |
| 1870 | PABPC1 | 3146809 | TTTGTTGGACGATTTAAGTCTCGTAAAGAACGAGAAGCTGAACTTGGAGCTAGGGCAAAAGAATTCACCAATG |
| 1871 | PABPC1 | 3146812 | TGAAAATGGTTCCAAGGGCTATGGATTTGTACACTTTGAGACGCAGGAAGCAGCTGA |
| 1872 | PABPC1 | 3146813 | GCTACATTTAGTTTAGTGCTTGAAATAGGAACTGTGCAGTAATGGATATCTTTATTTCACAAATATCCAGGTTAGATGGCTAACAGATTGTCTCTCAACA |
| 1873 | PABPC1 | 3146815 | GGAGCGTGCTTTGGACACCATGAATTTTG |
| 1874 | PABPC1 | 3146819 | CTACGAGAAGTTCAGCCCGGCCGGGCCCATCCTCTCCATCCGGGTCTGCAGGGACATGATCACCCGCCGCTCCTTGGGCTACGCGTATGTGAACTTCCAGCAGC |
| 1875 | PABPC1 | 3146820 | GTCGCGGCCTGTGGCCCTGCGGGCAGC |
| 1876 | PABPC1 | 3146821 | CCCGGCACTCGCTCTCCTCCTCTCACGGAAAG |
| 1877 | PABPC1 | 3146822 | GATTTTTGTCCCTCTGCGCTTGCTCCCCGCTCCCCT |
| 1878 | PABPC1 | 3146823 | TCGCTCCCCGCCGGCAGCCGGCAGCCAGCGGCAGTGGATCGACCCC |
| 1879 | PABPC1 | 3146824 | CCAAGAAGGAACCAAGAGACCGAGGCCTTCCCGCTGCCCGGACCCGACACCGCCACC |
| 1880 | PABPC1 | 3146825 | GCTGGCTCCATCTACGCACGTTTCGGAAACCGGGCCCGGAGGGGACCACGCCCGCTCACCCGTGCCCGGCGTCCCCCGGAGCTGGGGCTAGAGGAGCCGGGCCGGCCGCAGCGGGAAGGAGGCCACAGGCGGCCGCGCACGTGGGGGGTGGTTAGCGCGGAGGAACCCGGAAGCCCTTTGCACCGCCCACCGCCGCGGTGACGGGTTAACGCTCCTCCTGGTGGAGGCAGGGGCGGGCGGGGCGGAAGGCGGGGACGCCTCAGCCAACACCCCGAGGACCGCCCGCGAGCCGTCCTCCCCACCCCCACGGACGCGACGCAGCGCGGGCTCCGCTTCCCGGCCGCGGCGCCTGCGCAAAAGCCCCGCCCCCTTCGCCCGAGCCCCACCCCCACACCGCAGCCTCCACCGCCGCCACCTCTCCCTTCCTCTCTGCTCTTTCCTCCTGTTTTCTCTTCCCTCCTCCCCCTGGCCTCCGCGTCTCCTCCTACTCCGGCGCTGACGCTCGCGTAGGGCCCTGGCGTCAGACGCGCGGGGCGGGCGAGTGCGGCGCGGGGTATAAGTAGAGGGTGCAGGAGGCGGTGCTTCCCCTTCTCCCCGGCGGTTAGTGCTGAGAGTGCGGAGTGTGTGCTCCGGGCTCGGAACACACATTTATT |
| 1881 | PABPC1 | 3146826 | AGGCACCGCTTCTGCGGCCGACGCGCGTGGCGGCGGTGCCGGCTGGGACTCGTAGTGCGGTCCGG |
| 1882 | NDRG1 | 3154318 | GATCGGGGCAAGAGAGGCTGAGTACGGATGGGAAACTATTGTGCACAAGTCTTTCCAGAGGAGTTTCTTAATGAGATATTTGTATTTAT |
| 1883 | NDRG1 | 3154319 | GCTCACCGTGGATTTTCTCATAGGAAGTTTGGTCAGAGTGAATTGAATATTGTAAGTCAGCCACTGGGACCCGAGGATTTCTGGGACCCCGCAGTTGGGAGGAGGAAGTAGTCCAGCCTTCCAGGTGGCGTGAGAGGCAATGACTCGTTACCTGC |
| 1884 | NDRG1 | 3154320 | AGGTCTATTACGTGGGTGCCCTCTCCAAAGGCGGGGTGGCGGTGGACCAAAGGAAGGAAGCAAGCATCTCCGCATCGCATCCTCTTCCATTAACCAGTGGCCGGTTGCCACTCTCCTCCCCTCCCTCAGAGACACCAAACTGCCAAAAACAAGACGCGTAGCAGCACACACTTCACAAAGCCAAGCCTAGGCCGCCCTGAGCATCCTGGTTCAAACGGGTGCCTGGTCAGAAGGCCAGCCGCCCACTTCCCGTTTCCTCTTTAACTGAGGAGAAGCTGATCCAGTTTCCGGAAACAAAATCCTTTTCTCATTTGGGGAGGGGGTAATAGTGACATGCAGGCACCTCTTTTAAACAGGCAAAACAGGAAGGGGGAAAAGGTGGGATTCATGTCGAGGCTAGAGGCATTTGGAACAACAAATCTACGTAGTTAACTTGAAGAAACCGATTTTTAAAGTTGGTGCATCTAGAAAGCTTTGAATGCAGAAGCAAACAAGCTTGATTTTTCTAGCATCCTCTTAATGTGCAGCAAAAGCAGGCGACAAAATCTCCTGGCTTTACAGACAAAAATATTTCAGCAAACGTTGGGCATCATGGTTTTTGAAGGCTTTAGTTCTGCTTTCTGCCTCTCCTCCACAGCCCCAACCTCCCACCCCTGATACATGAGCCAGTGATTATTCTTGTTCAGGGAGAAGATCATTTAGATTTGTTTTGCATTCCTTAGAATGGAGGGCAACATTCCACAGCTGCCCTGGCTGTGATGAGTGTCCTTGCAGGGGCGGAGTAGGAGCACTGGGGTGGGGTGGAATTGGGGTTACTCGATGTAAGGGATTCCTTGTTGTTGTGTTGAGATCCAGTCAGTTGTGATTTCTGT |

TABLE 13-continued

Subtyping Target Sequences

| SEQ ID NO. | Gene | Affy Probeset ID | Sequence |
|---|---|---|---|
| | | | GGATCCCAGCTTGGTTCCAGGAATTTTGTGTGATTGGCTTAAATCCAGTTTTCAATCTTCGACA GCTGGGCTGGAACGTGAACTCAGTAGCTGAACCTGTCTGACCCGGTCACGTTCTTGGATCCTC AGAACTCTTTGCTCTTGTCGGGGTGGGGGTGGGAACTCACGTGGGGAGCGGTGGCTGAGAA AATGTAAGGATTCTGGAATACATATTCCATGGGACTTTCCTTCCCTCTCCTGCTTCCTCTTTTCC TGCTCCCTAACCTTTCGCCGAATGG |
| 1885 | NDRG1 | 3154321 | TTCCAGCGTCACTTCTCTGGATGGCACCCGCAGCCGCTCCCACACCAGCGAGGGCACCCGAA GCCGCTCCCACACCAGCGAGGGCACCCGCAGCCGCTCGCACACCAGCGAGGGGCCCACCT GGACATCACCCCCAACTCGGGTGCTGCTGGGAACAGCGCCGGGCCCAAGTCCATGGAGGTCTC |
| 1886 | NDRG1 | 3154322 | CTCGGCTAGCATGACCCGCCTGATGCGGTCCCGCACAGCCTC |
| 1887 | NDRG1 | 3154323 | AATTCGTGTGTCCTCCCTTACTAGGAAGTTATTGAACTTCTGATCCCTTTTATCATTTCCTTAAA CTGTTTGCCCATGTATAGTAAGAGTATGCTTGGTAAGCTGACTGCAGTCCTAGCATTGGCCTT AGCCATGATTAGCTCTAGCAAGGCGAGGCTGGCAGGTTTGATTTCCATGCCTCAGGCTCAGG CAGGATCCACATCCCCAGGTGCCCTCTTCCAACAGAAGCTATCTGCTAGTGGGGCTCCTGCCT TTCTAGCCTGCTTTCCCCGACGGAAGTTGCAGGCAAAGGTTGTCATTGGAGACAGCCATGGA GACAGCCGCGGGGCAGTCCTGCTTTACCCTGCACGGTGTGA |
| 1888 | NDRG1 | 3154324 | GCATGTGTCGGAATTGGAAGTGCTCTGTCCTGAGCCAGGTTTGGATGAGCAATTCTGTGTC |
| 1889 | NDRG1 | 3154325 | CAAGTACTTCGTGCAGGGCATGGGATACA |
| 1890 | NDRG1 | 3154328 | ATGGCGGACTGTGGCGGCCTCCCGCAGA |
| 1891 | NDRG1 | 3154333 | GGAGTGCAACTCAAAATTGGACCCAACAAAGACCACTCTCCTCAAG |
| 1892 | NDRG1 | 3154335 | GGTGGTTGGGGACAGCTCGCCTGCAGTGGATGCCG |
| 1893 | NDRG1 | 3154339 | GCGCAAAGAGATCCTGTGTTCTCCCCAAGGCCACACAGCTAGAAAGTGGCAGAGCATGATTT GGATCCTGCTTGTCTAACTCCAGGCTGTGAGCTGGGAAAGAGCTTCTCATGTTGGGAGC |
| 1894 | NDRG1 | 3154340 | TGCAGAGTAACGTGGAAGTGGTCCACACCTACCGCCAGCACATTGTGAATGACATGAACCCC GGCAAC |
| 1895 | NDRG1 | 3154341 | ATGGACCCAAGCTCTGCCGGACATGGTG |
| 1896 | NDRG1 | 3154342 | AGGAGCCCTTCCGTCCAGCCTGTATGACGTTCTGGAGTGGAACACACTCCCTGTTTTTATTTG ATTTTCCAGCAAAGGAAGTGACATTCCAGTCAACCCGCTGGGCTTCATGATAGCTGTCCTGAG TGAGACTCGAAGGTCTGGGGATGTCGACCACTGGCTAATGTGAAGCCTGAGGATTGTCTTTA ATAGCTGTACTATTCCCTTCAGTACAGCTTTAATAGCTGTACTATTCCCTTCTTTTTCAACTCCA GCCTTTCGATTACCAGGCATTGGTATTAGATACTGTGATGTGTGCAGTTACTTCTTGCAGTCCT TCCCTTGACCTTGTGGCCTTGAAGTTCCTGGCACTCCCAGTTCCAGATTAGAAGTCTGAGACCC AGAGGTATGCAGACTGCCCAGTGCCACACAGCTAGGCTGTGGCAGGCAAGGGCCAGCCAAA GACCCTTAGGTCTAGAGCTTCTCTCCTACTCATTTTTGCCTAATGCTTAGGTCAGCACACATTTA TGGAGCTTCTGCTGTATACTAGGACTTATAGAGCTCCTGCTGCAAACCTAGTCACTGGGGAGA GGTAGGAAAGAAGATTGTCAGTGTCTTTGGTAATATCAGTATACTTAGAAAGGGGAAACTG GCTTGGAGATGAGAGAGGAGGGATAGTTGGGAGCCAAGCATATCTTGGGGTATAGACTGGG GAGCTCAGTGTGTTTTTAGAAGAGGTGAATGGATGGCCCTCTTTGCTGAGGACTTGGTGAAT GTTTGGAGCAGGGTAAGCTAGCAGTAGCTGGGTCTTTATTCAGCACTTATTTGCTGTGCATCT TGTGCATGGGCCTCTGAA |
| 1897 | NDRG1 | 3154344 | TGGAGGGCCTTGTCCTTATCAACGTGAACCCTTGTGCGGAAGGCTG |
| 1898 | NDRG1 | 3154346 | CTGAAAAGCATTATTGGCATGGGAACAG |
| 1899 | NDRG1 | 3154347 | TGGTTTCTAGCATCTTCCTGCCCCTTGGCTTTGATCTGGACTGACCACTAAAATTAAGGTTGCA ATTTAGAGATGAGGCAAGAAATTAGCTCGTCACTCTGTGAACACT |
| 1900 | NDRG1 | 3154348 | GCTTCCTGGAGTCCTTCAACAGTTTGG |
| 1901 | NDRG1 | 3154349 | ACCCAGCACTTTGCCGTCTGCCACGTGGACGCCCCTGGCCAGCAGGACGGCGCAGCCTCCTTC CC |
| 1902 | NDRG1 | 3154350 | CCGAGACACCTAATTTTTTCTCATCTTACTTTTTTCTCTTCTCTCCCTCACTGCTGTTCTTCAG |
| 1903 | NDRG1 | 3154352 | AGCAGGACATCGAGACTTTACATGGCTCTGTTCACGTCACGCTGTGTGGGACTCCCAAGGGA AACCGGCCTGTCATCCTCACCTACCATGACATCGGCATGAA |
| 1904 | NDRG1 | 3154353 | CCCACTGTCTGCTGTGTCTCCTCAG |
| 1905 | NDRG1 | 3154361 | TCTCGGGAGATGCAGGATGTAGACCTCGCTGAGGTGAAGCCTT |

TABLE 13-continued

Subtyping Target Sequences

| SEQ ID NO. | Gene | Affy Probeset ID | Sequence |
|---|---|---|---|
| 1906 | NDRG1 | 3154364 | GGCGATGAGACGGTCCGAAAAAATACCAGGATAGCGTTTCCTGGCGTCGTCTCCGAATCCCAGCTGGCGCCGCTGGCA |
| 1907 | NDRG1 | 3154365 | CGGAGCTGCAAGTGCGCGGTCACCCCGGGGCGCGGGCGCGAGGGGGCTTTGGGTGCAGACACCGCTGAAGTGGGGGGTT |
| 1908 | NDRG1 | 3154366 | AGGGGCCGCCCGTGCGGTGCCGCTGGAGCGCCAGGACCGCCCTTTGTAG |
| 1909 | NDRG1 | 3154367 | GTAAGCCCGCGCCCTCTTCTCCCAG |
| 1910 | NDRG1 | 3154368 | GCTTGCGCAACAGGCGGCGGCTCCAGTGGGCGCCCGCCGCGCGCTGCCGGAGCCCAGCCCAGCCCGGCGCGCCCGGGAGGAGGGAGCAGGGAGCGGGAAGGGGTGTGTCCCGGCTGCGTGCTGGGACTGCGAGGGTCTGGGAGGGGCGAGGCGCGGGGGCGGGGCCGCGGCGCCTATAAAGTCGCCCTCCGCCCGGACGTAAACAAACCTCGCCTGGCTCCCAGCTGGTGCTGAAGCTCGTCAGTTCACCATCCGCCCTCGG |
| 1911 | NDRG1 | 3154369 | ATGGACGAGATTAAACGGGAGCGAGGATTTCAGCGAGAGCTTTGGCGACACGGAAGGCTGAGAATCGGAGGGAGCCTGTCGGGCGAAAGCGAAGGCGGCTGCTGGGCAGGCAGCCGAATCCGGCTGGAGA |
| 1912 | ACER2 | 3164328 | TGGTCAGTGTCCTGTCTGCGGTTACGACGT |
| 1913 | ACER2 | 3164335 | AAGTTCTGGCCCAATGAGAAATGGGC |
| 1914 | ACER2 | 3164336 | GAAGACAGCCAAGGGAGTTCGAATAGTTGG |
| 1915 | ACER2 | 3164337 | CTCCTCCTCCCTAATGTGTCTGTGGACCACCTGGATTCCACTGTACAAGGGGAAAAGTGTCTATTCCTTTCCCAAAGATGGAAAATGGAGGGCTTAGGGACACTAGATGCATCTTTCTCAGCATCACTTCCAGATGCAGTGACTTGTTGGGCTGCGTCCTTAATGGCCATG |
| 1916 | ANXA1 | 3174821 | GAAGGCAGCCAATTACTAACTTCTGGTTGCTAGGTGTGGCTTCCTTTAAAATCCTATAAAATCAGAAGCCCAAGTCTCCACTGCCAGTGTGAAATCTTCAGAGAAGAATTTCTCTTTAGTTCTTTGCAAGAAGGTAGAGATAAA |
| 1917 | ANXA1 | 3174824 | CATATTCGAGGAAAAACTATGCACAAGGCCGTGCATTTAAAAATAAACTCCCTAAGGCTGGGGTGAAACCTGCTACGGTCTGCGCAAGTTGACTGTTAATG |
| 1918 | ANXA1 | 3174829 | CAGCCAGGGCCTACTCTAAGAAGTTTCTTTAGCCCTTATGTTTTCCTATGGAGAGCACACACTAGCTTTAAGTCCTGAGGGTACTTAAGATGATATTTCAATGTTTTTGTACTCTTAGTGCTTGGCATATGGTGGGTGGTCTACAAATTTAGAACAATGTAGTGAACCACAAACTCCTCTCTTCAGCCTGTGTGCTTACTTGTAGTAGTTGTCTGATCTCTAAAATTTAGAACTGAATATGCCAAGAAAGAGTTCAATTTCAGAGAGGAGGGTATGGTTTCATTTTAAGTATAAAAGCTTCCTTTAAAAAAAATTACGTCTTACATTTTGTTATGCTCCTAAGTGTAATTGATCCTGGAAAGTAAGCGCAAGGCTACTCTCTAATG |
| 1919 | ANXA1 | 3174830 | GGTATCAGAATTCCTCAAGCAGGCCTGGTTTATTGAAAATG |
| 1920 | ANXA1 | 3174831 | GTCATCCAAAGGTGGTCCCGGATCAGCGGTGAGCCCCTATCCTACCTTCAATCCATCCTCGGATGTCGCTGCCTTGCATAAGGCCATAATG |
| 1921 | ANXA1 | 3174832 | GGATGAAGCAACCATCATTGACATTCTAACTAAGCGAAACAATGCACAGCGTCAACAGATCAAGCAGCATATC |
| 1922 | ANXA1 | 3174833 | CTTAACCATGGATTCGGAAGCACAGTTACCTAGTTCTTTAAGGTTCTAACCACTGTTTTCTCATTACATCTATGATTGGGATTGCAGTGTTTATCCACTTTGTTGCAATTTAATCATTTTATCAAATTTCCTATTTTTATACATTAGTCATCTTGGTGTATATTGTTTGCAGATGTGGTGCTCTGGGGACAAATTTTTAATTTGAACGTAAACATCGAGATTGCTGCTGTCAATAAAGAATATGGTC |
| 1923 | ANXA1 | 3174834 | CCCCTGGATGAAACACTGAAGAAAG |
| 1924 | ANXA1 | 3174835 | CCCTTACAGGTCACCTTGAGGAGGTTGTTTTAGCTCTGCTAAAAACTCCAGCGCAATTTGATGCTGATGAACTTCGTGCTGCCATGA |
| 1925 | ANXA1 | 3174836 | AGATACTCTAATTGAGATTTTGGCATCAAGAACTAACAAAGAAATCAGAGACATTAACAGGGTCTACAGAGA |
| 1926 | ANXA1 | 3174838 | TGAAGAGAGATCTGGCCAAAGACATAACCTCAGACACATCTGGAGATTTTCGGAACGCTTTGCTTTCTCT |
| 1927 | ANXA1 | 3174840 | GTGACCGATCTGAGGACTTTGGTGTGAATGAA |
| 1928 | ANXA1 | 3174845 | GGGACAGACGTAAACGTGTTCAATACCATCCT |
| 1929 | ANXA1 | 3174847 | CACCAAGTACAGTAAGCATGACATGAACAAAGTTCTGGACCTGGAGTTGAAAGGTGACAT |

TABLE 13-continued

Subtyping Target Sequences

| SEQ ID NO. | Gene | Affy Probeset ID | Sequence |
|---|---|---|---|
| 1930 | ANXA1 | 3174850 | TGAAGTGCGCCACAAGCAAACCAGCTT |
| 1931 | ANXA1 | 3174852 | GCTAGGTACTGCTCTGTAGTGGTTAGCATAGTTGCTGCCCCCTTTCTGCCATAGTCTAGTGTGA TATTTCGTTGGGTAATGATGAATACCTGGTGCCATGGAAGAGAAAAGTGGGACATATACTCC AGACTTTGGAAATCCAGGTAGCATTGCTGTCAGCTAAATTAACACCTGAAGTTTAAATAGAAA TGAGCCAGATGAGGGCAAGAGTGGAAGAGATGGGGATAAAGCAAGGGTGGTCCAAGAGGA AGAAGTAACCCACACACAGGCTTGAAGGCAAAAGGTAACATAACCTTCTCAAGACAGTAAGT ATAGAGTGATGGTGCACACTGGAAGAGATGGTAGAATTAGGCAGGATATTGTAAGCCTTGA AAAAGAATTAGGCAGGATATCGGAAGCCCTGATTAGATTCTATC |
| 1932 | ANXA1 | 3174853 | CGCCATAAGGCATTGATCAGGATTATGGTTTCCCGTTCTGAAATTGACATGAATGATATCAAA GCATTCTATCAGAAGATGTATGGTATCTCCCTTTGCCAAGCCATC |
| 1933 | ANXA1 | 3174856 | GATGAAACCAAAGGAGATTATGAGAAAATCCTGGTGGCTCTTTGTGGAGGAA |
| 1934 | ANXA1 | 3174857 | ACATTCCCTTGATGGTCTCAAGCTATGATCAGAAGACTTTAATTATATATTTTCATCCTATAAGC TTAAATAGGAAAGTTTCTTCAACAGGATTACAGTGTAGCTACCTACATGCTGAAAAATATAG |
| 1935 | DAPK1 | 3177901 | CAGAACCCGCAGCGCCGGCCTGGCAGGGCA |
| 1936 | DAPK1 | 3177902 | CGCCGCCAGCCCGCTTGCAGGGTCCCCATTGGCCGCCTGCCGGCCGCCCTCCGCCCAAAGG CGGCAAGGAGCCGAGA |
| 1937 | DAPK1 | 3177903 | TTCCCTCCGCGGAGGGGACTCGGCAACTCGCAGCGGCAGGGTCTGGGGCCGGCGCCTGGGA GGGATCTGCGCCCCCCACTCACTCCCTA |
| 1938 | DAPK1 | 3177904 | TAGTCTCCGGCGCTGGCGCCTATGGTCGGCCTCCGACAGCGCTCCGGAGGGACCG |
| 1939 | DAPK1 | 3177905 | CTGGGCGAGGGCTTCATTCTTCCGCGGCGTCCCT |
| 1940 | DAPK1 | 3177906 | GAGCGGTGGTGATGGTCTGGGAAGCGGAGCTGAAGTGCCCTGG |
| 1941 | DAPK1 | 3177907 | AGGAAAACGTGGATGATTACTACGACACCGGCGAGGAACTTGGCAG |
| 1942 | DAPK1 | 3177918 | CAGTTTGCGGTTGTGAAGAAATGCCGTGAGAAAAGCACCGGCCTCCAGTATGCCGCCAAATT CATCAAGAAAGGAGGACTAAGTCCAGCCGGCGGGGTGTGAGCCGCGAGGACATCGAGCG GGAGGTCAGCATCCTGAAGGAGATCCAGCACCCCAATGTCATCACCCTGCACGAGGTCTATG AGAACAAGACGGACGTCATCCTGATCTTGGA |
| 1943 | DAPK1 | 3177925 | CCTGAGAACATAATGCTTTTGGATAGAAATGTCCCCAAACCTCGGATCAAGATCATTGACTTT |
| 1944 | DAPK1 | 3177926 | CTCCTGAGATAGTCAACTATGAACCTCTTGGTCTTGAGGCAGATATGTG |
| 1945 | DAPK1 | 3177927 | GAGTATCGGGGTAATAACCTATATC |
| 1946 | DAPK1 | 3177928 | GAAACGTTAGCAAATGTATCCGCTGTCAACTACGAATTTGAGGATGAATACTTCAGTAATACC AGTGCCCTAGCCAAAGATTTC |
| 1947 | DAPK1 | 3177929 | TGACAATTCAAGATAGTTTGCAGCATCCCTGG |
| 1948 | DAPK1 | 3177930 | CCTAAAGATACACAACAGGCACTTAGTAGAAAAGCATCAGCAGTAAACATGGAGAAATTCAA GAAGTTTGCAGCCCGGAAAAAATG |
| 1949 | DAPK1 | 3177932 | AATCCGTTCGCTTGATATCACTGTGCCAAAGATTATCCAGGTCATTCCTGTCCAGAAGTAACAT GAGTGTTGCCAGAAGCGATGATACTCT |
| 1950 | DAPK1 | 3177933 | AGACTCCTTTGTGATGAAAGCCATCATCCATGCCATCAACGATGACAATGTCCCAGGCCTGCA GCACCTTCTGGGCTCATTATCCAACTATGATGTTAACCAACC |
| 1951 | DAPK1 | 3177936 | GGGTCCAATGCCGTCTACTGGGCTGCTCGGCATGGCCACGTCGATACCTTGAAATTTCTC |
| 1952 | DAPK1 | 3177938 | TCCACGTGGCAGCTCGCTATGGCCATGCTGACGTGGCTCAGTTACTGTGCAGCTTCGGCTCAA ATCCCAATATCCAGGACA |
| 1953 | DAPK1 | 3177940 | TGCTGCTTGGCACGGCTATTACTCTGTGGCCAAAGCCCTTTGTGAAGCCGGCTGTAACGTGAA CATCAAGAACCGAGAAGGAGAGACGCCCCTCCTGACAGCCTCTGCCAGGGGCTACCACGACA TCGTGGAGTGTCTGGCCGAACATGGAGCCGACCTTA |
| 1954 | DAPK1 | 3177942 | CTTCATCTGGCTGTAAGACGGTGTCAGATGGAGGTAATCAAGACTCTCCTCAGCCAAGGGTG TTTCGTCGATTATCAAGACAGGCACGGCAATACTCCCCTCCATGTGGCATGTAAAGATGGCAA CATGCCTATCGTGGTGGCCCTCTGTGAAGCAAACTGCAAT |

TABLE 13-continued

Subtyping Target Sequences

| SEQ ID NO. | Gene | Affy Probeset ID | Sequence |
|---|---|---|---|
| 1955 | DAPK1 | 3177943 | CAGTTCCCTGGGTTACCTTGGCACACAATTTGGGAACCATAGGCACAAACAAGGCTTATGGGCTTGTCCTGGTATTTTCACTAATTAGGATGTCTTCAATATCTGTCTTCCATGTCTTCCCTGGCTGTGTCTAAATTTGAACTATGGTGCAGATCTTGCTGGAACTCTGGACCTTGAGCCCTTGACTCCTGTCTCTTTCAGGCCAGCACAGCAGGAAACTTACTTAAGTTATCTTTGAAGTTGTATTTTGAAGCTCCTCTTTTAATTGCAAAGTACTTGGAAAGGTTCTGCCTGGCTG |
| 1956 | DAPK1 | 3177944 | TCCTTAACCTTGTGTCTCCGGAATGTCATCCTCAGCAACTGCGTGAGAAGAACGACCTTTGGCCTT |
| 1957 | DAPK1 | 3177947 | CCTCTCAGGGGTGACTTCAAGGACTGAGGCTTGCAGAGAGCACTGAGAGCTGGGTCGAGCACATATTATGAGGTGGTGTTCAATAAATACTTGCTGTCATCGTGTATGTTCATGGTGTAGA |
| 1958 | DAPK1 | 3177948 | TGGCTTGCTTCTCACACCTGCTATGCTTGTTTCTGCCTCAGACCCACGGAATTGGCGTATGGAACACACA |
| 1959 | DAPK1 | 3177949 | ACGGAAAGACGGCAGAAGATCTTGCTAGATCGGAACAGCACGAGCACGTAGCAGGTCTCCTTGCAAGACT |
| 1960 | DAPK1 | 3177950 | CTCTAGACAGCCAGGTTTTAGGAACAGTGGTCCCTGTCCTGTGGTTTACATGTCAGTCGGTATAAATGCATCAGCTCCCTATCTGTTTTCTTCTCTATTTGGACTTGGAAATCATTTAGCATGTTTGCAGTTGCCGTGCC |
| 1961 | DAPK1 | 3177952 | ACCGAGGACTCTTCATCCAGCAGCTCCGACCCACACAGAACCTGCAGCCAAGAATTAAGCTCAAGCTGTTTGGCCACTCGGGATCCGGGAAAACCACCCTTGTAGAATCTCTCAAGTGTGGGCTGCTGAGGAGCTTTTTCAGAAGGCGTCGGCCCA |
| 1962 | DAPK1 | 3177954 | TCTCAGTGAGCATCAACAACCTGTACCCAG |
| 1963 | DAPK1 | 3177955 | AGGAGCCGCAGCATGATGTTCGAGCCGGGTCTTACCAAAGGGATGCTGGAGGTGTTTGTGGCCCCGACCCACCACCCGCACTGCTCGGCCGATGACCAGTCCACCAAGGCCATCGACATCCAGAACGCTTA |
| 1964 | DAPK1 | 3177956 | CGATTTCAGCGTGTGGGAGTTCTCTGGAAATCCTGTGTATTTCTGCTGTTATGACTATTTTGCTGCAAATGATCCCACGTCAATCCATGTTGTTGTCTTTAGTCTAGAAGAGCCCTATGAGATCCAGCTGAACCAAGTGATTTTCTGGCTCAGTTTCCTGAAGTCCCTTGTCCCAGTTGAAGAACCCATA |
| 1965 | DAPK1 | 3177957 | CCTTGTGGCCTAGGAGATAGGCTTATCCTGTCGTTGGCCATGCTGGGGCCTTCTAGGGTCACAGTGCACAGCAGGCGTGGGCCTTCATCTCTGTGGCATGTTGCACTTGTACC |
| 1966 | DAPK1 | 3177958 | TGGCCACCCACGCTGACATCATGAATGTTCCTCGACCGGCTGGAGGCGAGTTTGGATATGACAAAGACACATCGTTGCTGAAAGAGA |
| 1967 | DAPK1 | 3177959 | AAGGACATGAAGGTACTTCGAAATCATCTGCAAGA |
| 1968 | DAPK1 | 3177960 | CGAGGAGGACCTCAGGCGCATTGCTCAGCAGC |
| 1969 | DAPK1 | 3177961 | CTCCTGACCGTGAAGCATTACCTGAGCCCCCAGCAGCTGCGGGAGCACCATGAGCCCGTCATGATCTACCAGCCACGGGACTTCTTCCGGGCACAGACTCTGAAGGAAACCTCACTGACCAACACCATGGGGGGTACAAGGAAAGCTTCAGCAGCATCATGTGCTTCGGGTGTCACGACGTCTACTCACAGGCCAGCCTCGGCATGGACATCCATGCATCAGACCTGAACCTCCTCACTCGGAGGAAACTGAGTCGCCTGCTGGACCCGCCCGACCCCCTGGGGAAGGACTGGTGCCTTCTCGCCATGAACTTAGGCCTCCCTGACCTCGTGGCAAAGTACAACACCAGTAACGGGGCTCCCAAGGATTCCTCCCCAGCCCCCTCCACGCCCTGCTGCGGGAATGGACCCACCTACCCTGAGAGCACAGTGGGCACCCTCATGTCCAAACTGA |
| 1970 | DAPK1 | 3177962 | TAGTGTACCTCCTCTCAGTGTTTTGGACTCCATCTCTCATCCTCCAGTACCTTGCTTCTTACTGATAATTTTGCTGGAATTCCTAACTTTTCAATGACATTTTTTTAACTACTATATTGATTGTCCTTTAAAAAAGAAAAGTGCATATTTATCCAAAATGTGTATTTCTTATACGCTTTTCTTTGTTATACCATTTCCTCAGCTTATCTCTTTTATATTTGTAGGAGAAACTCCCATGTATGGAATCCCACTGTATGATTTATAAACAGACAATATGTGAGTGCCTTTTGCAGAAGAGGGTGTGTTTGAAATCATCGGAGTCAGCCAGGAGCTGTCACCAAGGAAACGTACCTCTCTGTCCCTTGCTGTATGCTGATCATCGCCAGAGGTGCTTCACCCTGAGTTTTGTTTTGTATTGTTTTCTGACAGTTTTTCTGTTTTGTTTGGCAAGGAAAGGGGAGAAGGGAATCCTCCTCCAGGGTGATTTTATGATCAGTGTTGTTGCTCTAGGAAGACATTTTTCCGTTTGCTTTTGTTCCAATGTCAATGTGAACGTCCACATGAAACCTACACACTGTCATGCTTCATCATTCCCTCTCATCTCAGGTAGAAGGTTGACACAGTTGTAGGGTTACAGAGACCTATGTAAGAATTCAGAAGACCCCTGACTCATCATTTGTGGCAGTCCCTTATAATTGGTGCATA |
| 1971 | DAPK1 | 3178013 | AAGAAGTTGACACTCCGATTTTCCACATCATCTAACTAAAATGGATTTAAACTAACTTTCTCTAACTATTAAATCTTTCTTAGGTAAGTACAGTTGTATCCCAGCTCTAGAGTTAATGTGCTGGG |
| 1972 | DAPK1 | 3178023 | CGCTCTTGTTGCGTGTGTTCAAACAACCGGCACGGTC |
| 1973 | DAPK1 | 3178055 | TCGGTCTGTTGCCCAGGCGGGTGTGCA |

TABLE 13-continued

Subtyping Target Sequences

| SEQ ID NO. | Gene | Affy Probeset ID | Sequence |
|---|---|---|---|
| 1974 | DAPK1 | 3178057 | CCCGATCGGGAAACTCTGCTGTCAACTAAGCAAACTCTAAATTTAACATTTGGGGGACCCCCT<br>TGGAGAGTAGTTGAGAGCTATGTGCTCCCCTTTTCAGAAAAATGCTCTCAAATACTCAGTGCA<br>TAAGCCCACAGCCTTAGCAGGTTCCCAGACCTTAGGTCAGCAATCCTGTTCTAAGGCATACAT<br>CACGAGCAGCATTTTGATTTTCATCTGGGGAACTTATAGTTCATAAAGACCTACTGATCCATTA<br>AATTTCCACTTGATTTTGCCATTAGTAATCTCTTAAACAAGTCCAAGGAAGCCAGAGGAAGT<br>TATTTCTTGAATGCTTTTATACTAGTGCTTTCAAGAGTTCGTGTTGCTGACTCCAGTTTTTAAAA<br>TTATTATTCTCATCTTCTGCAATGCCTCGAGGCATGTTTTTAGCTGAATA |
| 1975 | TPM2 | 3204722 | CCCAGCCAGGCTATGGTTGCCACCCCAACCCAATAAAACTGATGT |
| 1976 | TPM2 | 3204723 | GCCAAGGAGGAGAACGTCGAGATTCACCAGACCTTGGACCAG |
| 1977 | TPM2 | 3204724 | CTCTATGACCCCAAGGCCTTGAGTGAGGCATCCACGTCCGTCCTGTTCCCCTCATCCTAGTCAG<br>TCCATCTGTTTGTCCCTGCCAAGGGGCCCTGAGGTCCGTGAATGCATGTGTCTTCCTTGACCCA<br>CTCCATGTCTATATGTCACCTTCC |
| 1978 | TPM2 | 3204725 | ACGGAGCACTGGTTCACTCCTGACACCCTGGCACTTACTGACACCCCCAGCCCCTGCACTGAG<br>CCCACCCACAAAACACCATGGCCCACGCTGAAACCCCTCTGCACAGGCACTCCCTGGCTGTCG<br>CTCTCTGATTCACCACTGCATGTGGGCACGTGTGGCCCCATCAAACCATGACCGCCTCTGGTG<br>CCAATCCCTGACCTCAGAGCACTTAGCTGGGGTTCCAGGATCAAACAGAGTGACTGGAAAGG<br>AAGTAGGGTGGTGAGGTGCAGGACAGGGGCAAGAAGGTTGCAAAAGGTCTGGAATGGAGC<br>TTGGAAAAATGTTGGATATCAGCAACATGGGCTTTCACTG |
| 1979 | TPM2 | 3204726 | TCCTTTGCTGCTTAATAAATTCTGAACTTGG |
| 1980 | TPM2 | 3204727 | CCACGCCAGCGTGGCCACCTCAGCTCTCTTCTCTCCTCTCCTTTCCATTCTCTCTATGGGGAGG<br>GGAGCAGGCAGGAGGAGCAGAAATTGCCAACATTGCA |
| 1981 | TPM2 | 3204728 | AGGAACTGGACAACGCACTCAATGACATCACCT |
| 1982 | TPM2 | 3204729 | GACCCGAGCAGAGTTTGCCGAGAGGTCTG |
| 1983 | TPM2 | 3204730 | GAAGAGGAGATCAAACTGTTGGAGGA |
| 1984 | TPM2 | 3204731 | CAAGATGACCAGGAGCCTACGGGGTACAATGGAGAAATGAAGGATCTGTGGTAGCGCTGTA<br>CTGATGGCGTGTGTGTGTCCC |
| 1985 | TPM2 | 3204732 | TGAAAATTGTTACCAACAACTTGAA |
| 1986 | TPM2 | 3204733 | TTTCTGGGCAATGGCGCCTTCTCTCAGCTCACCTTCCCTCCGTCTCAGCACCGCAGGCTGCTCT<br>TTCTCAGCTGCTGGGGATCAGGAAGGGCCTGGGGCTTCTGAGCCCTGCCTGCTGTCACTCTCA<br>CAACTTTGCTCTTCTCTTCTCCTCCACCCGTCCCTGCTGTGCCATCTCCACTGTCTGGCTTCG<br>CTGTGCCCTCACA |
| 1987 | TPM2 | 3204734 | TGGAGGAGGAACTTCGAACCATGGACCAGGCC |
| 1988 | TPM2 | 3204735 | GGGTGACAAGTGAGCCCATTGGCCCTGGGGCCTTCCACACAGTGGGAAGGTAGCATCCTAG<br>GCTTGGGGC |
| 1989 | TPM2 | 3204736 | TGGCCAGGAAGCTGGTGATCCTGGAAGGAGAGCTGGAGCGCTCGGAGGAGAGGGCTGA |
| 1990 | TPM2 | 3204737 | GGAGGCCAAGCACATCGCTGAGGATTCAG |
| 1991 | TPM2 | 3204738 | AGAAGGCGGCTGATGAGAGCGAGAG |
| 1992 | TPM2 | 3204739 | GATGTGGCCTCCCTGAACCGCCGCATTCAGCTGGTTGA |
| 1993 | TPM2 | 3204740 | AGAAACTGGAGCAGGCCGAGAAGAAGGCCACT |
| 1994 | TPM2 | 3204741 | GATGAGGTGGAAAAGTATTCTGAATCC |
| 1995 | TPM2 | 3204742 | ATCGACCGCGCCGAGCAGGCCGAAGCCGACAAGAAGCAAGCTGAGGACCGCTGCAAGCAG |
| 1996 | TPM2 | 3204743 | TTCAGCATAAAGTTGGCCCACTGGGAAAGAGAGGAGCGTCCGCGGGGAGCGGGGGAGAAG<br>AGGGAAGGCGCGCGGAGGGGAGTGGGGCCAGGCGGAGCCAGGGGCGGGGAGCGGAGGG<br>GCTCGGGACGCGTCCGGGTGGGAGCGGGGGCGGGAACGCGCGGTGACCAGCCTGGCCGC<br>AGCCGCGTGGAAAATATGCGGGGCACGTGGGGGCGGGGCGGGGAGCTGGGTCCTGAGCC<br>GCCGGGTGCTCGCAGGAAGGGCCTGGCTCCAGGGGCAGGGGCTGGGAGGGGAGGCGAGG<br>GGATGAGAGGTCAGGCCGGTCCTGGGGGCAGCAAGCCGGCCACACTCCCCACCGCGACCG<br>GGGCTCTGGGCTCGCTTCCTGCTTCAGTTTCCCCAAGCTCCCGATGAGACTCCGCTACTACCAC<br>CACGTCGATAACGCAAACCTAGAGGGACTCAGGGTAAACTGAGGCACTCAAACTGCCGAGG<br>AGCTCCGCCTCCCGAGAGACATTTAA |

TABLE 13-continued

Subtyping Target Sequences

| SEQ ID NO. | Gene | Affy Probeset ID | Sequence |
|---|---|---|---|
| 1997 | ASPN | 3214846 | TCATGTCTTAGAGCCCGTCTTTATGTTTAAAACTAATTTCTTAAAATAAAGCCTTCAGTAAATGTTCATTACCAACTTGATAAATGCTACTCATAAGAGCTGGTTTGGGGCTATAGCATATGCTTTTTTTTTTTTAATTATTACCTGATTTAAAAATCTCTGTAAAAACGTGTAGTGTTTCATAAAATCTGTAACTCGCATTTTAATGATCCGCTATTATAAGCTTTTAATAGCATGAAAATTGTTAGGCTATATAACATTGCCACTTCAACTCTAAGGAATATTTTGAGATATCCCTTTGGAAGACCTTGCTTGGAAGAGCCTGGACACTAACAATTCTACACCAAATTGTCTCTTCAAATACGTATGGACTGGATAACTCTGAGAA |
| 1998 | ASPN | 3214847 | CTAATTCAATTGCAAGAGTGGGAGTAAATGACTTCTGTCCAACAGTGCCAAAGATGAAGAAATCTTTATACAGTGCAATAAGTTTATTCAACAACCCGGTGAAATACTGGGAAATGCAACCTGCAACATTTCGTTGTGTTTTGAGCAGAATGAGCGTTCAGCTTGGGAAC |
| 1999 | ASPN | 3214850 | ATCACAGATATCGAAAATGGGAGTCTTGCTAACATACCACGTGTGAGAGAAATACATTTGGAAAACAATAAACTAAAAAAAATCCCTTCAGGATTACCAGAGTTGAAATACCTCCAG |
| 2000 | ASPN | 3214856 | TAATAATGGGATAGAGCCAGGGGCATTTGAAGGGGTGACGGTGTTCCATATCAGAATTGCAGAAGCAAAACTGACCTCAGTTCCTA |
| 2001 | ASPN | 3214857 | CCTGAACAACAACAAGCTAACGAAGATTCACCCAAAAGCCTTTCTAACCACAAAGAAGTTGCGAAGGCTGTATCTGTCCCACAATCAACTAAGTGAAATACCACTTAATCTTCCCAAATCATTAGCAGAACTC |
| 2002 | ASPN | 3214859 | ATTCCATTTGATACTCGAATGCTTGATC |
| 2003 | ASPN | 3214862 | TTTGATCTGTTTCCAATGTGTCCATTTGGATGTCAGTGCTATTCACGAGTTGTACATTGC |
| 2004 | ASPN | 3214863 | TGTGCTCCTATTATTCCTGGCTTTGTGCTCTGCCAAACCCTTCTTTAGCCCTTCACACATCGCACTGAAGAATATGATGCTGAAGGATATGG |
| 2005 | ASPN | 3214866 | TGGACTAATCTGTGGGAGCAGTTTATTCCAGTATCACCCAGGGTGCAGCCACACCAGGACTGTGTTGAAGGGTGTTTTTTTCTTTTAAATGTAATACCTCCTCATCTTTTCTTCTTACACAGTGTCTGAGAACATTTACATTATAGATAAGTAGTACATGGTGGATAACTTCTACTTTTAGGAGGACTACTCTCTTC |
| 2006 | FBP1 | 3215572 | ATGCTTGGCACTCCCTAACCAAATGCTGTCTCCATAATGCCACTGGTGTTAAGATATATTTTGAGTGGATGGAGGAGAAATAAACTTATTCCTC |
| 2007 | FBP1 | 3215573 | GCCTGCATCCGGAGAATTGCCTCTACCTGGACCTTTTGTCTCACACAGCAGTACCCTGACCTGCTGTGCACCTTACATTCCTAGAGAGCAGAAATAAAAAGCATGACTATTTCCACCA |
| 2008 | FBP1 | 3215574 | TCCTGAAGGTGTATGAGAAGCACTCTGCCCAGT |
| 2009 | FBP1 | 3215575 | AAGGAGGCCGTGTTAGACGTCATTCCCACAGACATTCACCAGAGGGCGCCGGTGATCTTGGGATCCCCCGACGA |
| 2010 | FBP1 | 3215577 | ATTCAGCTCCTTATGGGGCCCGGTATGTGGGCTCCATGGTGGCTGATGTTCATCGCACTCTGGTCTACGAGGGATATTTCTGTACCCCGCTAACA |
| 2011 | FBP1 | 3215579 | CTTAACGAGGGCTACGCCAGGGACTTTGACCCTGCCGTCACTGAGTACATC |
| 2012 | FBP1 | 3215584 | CTGAGAAGGATGCTCTGCAACCAGGCCGGAACCTGGTGGCAGCCGGCTACGCACTGTATGGCAGTGCCACCATGCTGGTCCTTGCCATGGACTGTGGGGTCAACTGCTTCATGCT |
| 2013 | FBP1 | 3215586 | GTGGTCTGTTTTGATCCCCTTGATGGATCTTCCAACATCGATTGCCTTGTGTCCGTTGGAACCATTTTTG |
| 2014 | FBP1 | 3215587 | CTGGTTCTACCAACGTGACAGGTGATCAAGTTAAGAAGCTGGACGTCCTCTCCAACGACCTGGTTATGAACATGTTAAAGTCATCCTTTGCCACGTGTGTTCTCGTGTCAGAAGA |
| 2015 | FBP1 | 3215590 | AGGCGCCCTTCGACACGGACGTCAACACCCTGACCCGCTTCGTCATGGAGGAGGGCAGGAAGGCCCGCGGCACGGGCGAGTTGACCCAGCTGCTCAACTCGCTCTGCACAGCAGTCAAAGCCATCTCTTCGGCGGTGCGCAAGGCG |
| 2016 | FBP1 | 3215591 | CCCCGCACCTGCCGCTTGCACCTGC |
| 2017 | FBP1 | 3215592 | TGCGGCCAGTGCCTACTGCCCTCTCTTGCCGCCCGCACCT |
| 2018 | TNC | 3222171 | GTAAGTATTGTTACCACACATGGGCTAAGATCCCCAGAGGCAGACTGCCTGAGTTCAATTCTTGGCTCCACCATTCCCAAGTTCCCTAACCTCTCTATGCCTCAGTTTCCTCTTCTGTAAAGTAGGGACACTCATACTTCTCATTTCAGAAACATTTTTTGTGAAGAATAAATTATGTTATCCATTTGAGGCCCTTAGAATGGTACCCGGTGTATATTAAGTGC |
| 2019 | TNC | 3222172 | TTCACCAAAGCCAATCATTTGAACAAAGCGGGGAATGTTGGGATAGGAAAGGTAAGTAGGGATAGTGGTCAAGTGGGAGGG |

TABLE 13-continued

Subtyping Target Sequences

| SEQ ID NO. | Gene | Affy Probeset ID | Sequence |
|---|---|---|---|
| 2020 | TNC | 3222173 | AAACATTTCTGGACAGTACCTGATTGTA |
| 2021 | TNC | 3222174 | TACATTTCATACAACAGAAACCAGAAAAGCAATACTGTTTCCATTTTAAGGAT |
| 2022 | TNC | 3222175 | CCAGTGACAACATCGCAATAGTTTTTTACTTCTCTTAGGTGGCTCTGGGAATGGGAGAGGGGTAGGATGTACAGGGGTAGTTTGTTTTAGAACCAGCCGTATTTTACATGAAGC |
| 2023 | TNC | 3222176 | AACCAGCCCAACCATCGGTCCACACCTGGGCATTTGGTGAGAGTCAAAGCTGACCATGGATCCCTGGGGCCAACGGCAACAGCATGGGCCTCACCTCCTCTGTGATTTCTTTCTTTGCACCAAAGACATCAGTCTCCAAC |
| 2024 | TNC | 3222177 | TTAACTGGTTCCACTGGAAGGGCCACGAACACTCAATCCAGTTTGCTGAGATGAAGCTGAGACCAAGCAACTTCAGAAATCTTGAAGGCAGGCGCAAACGGG |
| 2025 | TNC | 3222181 | CAGATTCAGCCATCACCAACTGTGCTCTGTCCTACAAAGGGGCTTTCTGGTACAGGAACTGTCACCGTGTCAACCTGATGGGAGATATGGGACAATAACC |
| 2026 | TNC | 3222183 | ACAGCCCAGGGGCAGTACGAGCTCCGGGTGGACCTGCGGGACCATGGGGAGACAGCCTTTGCTGTCTATGACAAGTTCAGCGTGGGAGATGCCAAGACT |
| 2027 | TNC | 3222186 | CCAAGGACTGCTCCCAAGCAATGCTGAATGGAGACACGACCTCTGGCCTCTACACCATTTATCTGAATGGTGATAAGGCTGAGGCGCTGGAAGTCTTCTGTGA |
| 2028 | TNC | 3222187 | TGGGTCCAGATACCACCTCCTACAGCCTGGCAGACCTGAGCCCATCCACCCACTACACAGCCAAGATCCAGGCACTCAATGGGCCCCTGAGGAGCAATATGATCCAGAC |
| 2029 | TNC | 3222188 | TCCAAGAGACTTGACTGCTACTGAGGTTCAGTCGGAAACTGCCCTCCTTACCTGGCGACCCCCCCGGGCATCAGTCACCGGTTACCTGC |
| 2030 | TNC | 3222189 | CTGGCCCTAAACCTAGTATTTAATGATCCACGTTCCAGGCAGGAAAATATTTTTGAAGAGGCATATTTTTTAGGCAATTTTTCCTAGATGTTTGTTAGGTTTCTATACATTGAGAGCTTTTTACAAACTATAGCAAGCAGGGAAAC |
| 2031 | TNC | 3222192 | GCCACTGTGGACAGTTATGTCATCTCCTACACAGG |
| 2032 | TNC | 3222194 | CTGTGGACGGAACCAAGACTCAGACCAGGCTGGTGAAACTCATACCTGGCGTGGAGTACCTTGTCAGCATCATCGCCATGAAGGGCTTT |
| 2033 | TNC | 3222195 | CATCACTGAAAATTCGGCTACTGTCAGCTGGAGGGCACCCACAGCCCAAGTGGAGAGCTTCCGGATTACCTATGTGCCCATTACAGGA |
| 2034 | TNC | 3222198 | CGAACCGGAAGTTGACAACCTTCTGGTTTCAGATGCCACCCCAGACGGTTTCCGTCTGTCCTGGACAGCTGATGAAGGGGTCTTCGACAATTTTGTTCTCAAAATACAGAGATACCAAAAAGCAGTCTGAGCCACTGGAAATAACCCTACTTGCCCCCGAACGTACCAGGGACATAACAGGTCTCAGAGAGGCTACTGAATACGAAATTGAACTCTATGGAATAAGCAAAGGAAGGCGATCCCAGACAGTCAGTGC |
| 2035 | TNC | 3222205 | CGGGTTCACAGTTTCCTGGATGGCATCGGAGAATGCCTTTGACAGCTTTCTAGTAACGGTGGTGGATTCTGGGAAGCTGCTGGACCCCCAGGAATTCACACTTTCAGGAACCCAGAGGAAGCTGGAGCTTAGAGGCCTCATAACTGGCATTGGCTATG |
| 2036 | TNC | 3222207 | CCACAGTTGGGCACGCTAATCTTTAGCAATATTACTCCAAAAAGCTTCAACATGTCATGGACCACTCAAGCTGGGCTTTTTGCAAAGATTGTTATCAATGTGAGTGACGCTCACTCACTGCATGAGTCCCAGCAATTCACAGTCTCAGGAGATGCAAAGCAAGCTC |
| 2037 | TNC | 3222208 | GTGTCTCGCAGCTCTGTCATCACCAACCTCAAAGCTTCTTCCTAATTACACTGCCCACCTTCATGGGCTGATTGGCGGGCAGCGTGCTCAGACCCTGATGGTC |
| 2038 | TNC | 3222209 | TCACTGTCTCAAACATGACCTGGGGCAGTGTGTCCATCTCGTGGGAAGCTCAGGAGTCTGCCTTTGATAGCTTTCTTATAGAAGTTAGTAATTCCGATCACCC |
| 2039 | TNC | 3222210 | GTTTCTGACATAACTCCCGAGAGCTTCAATCTCTCCTGGATGGCTACCGATGGGATCTTCGAGACCTTTACCATTGAAATTATTGATTCCAATAGGTTGCTGGAGACTGTGGAATATAATATCTCTGGTGCTGAACGAACTGCCCATATCTCAGGGCTACCCCCTAGTACTGATTTATTGTCTACCTCTCTGGACTTGCTCCCAGCATCCGGACCAAAACCATCAGTG |
| 2040 | TNC | 3222212 | CACAGCTGGAGATTTAGCCGTGTCTGAGGTTGGCTGGGATGGCCTCAGACTCAACTGGACCGCAGCTGACAATGCCTATGAGCACTTTGTCATTCAGGTGCAGGAGGTCAACAAAGTGGAGGCAGCCCAGAACCTCACGTTGCCTGGCAGCCTCAGGGCTGTGGACATCCCGGGCCTCGAGGCTGCCACGCCTTATAGAGTCTCCATCTATGGGGTGATCCGGGGCTATAGAACACCAGT |

TABLE 13-continued

Subtyping Target Sequences

| SEQ ID NO. | Gene | Affy Probeset ID | Sequence |
|---|---|---|---|
| 2041 | TNC | 3222214 | ACCGAGGTTAGCTGGGATGCTCTCAGACTGAACTGGACCACGCCAGATGGAACCTATGACCAGTTTACTATTCAGGTCCAGGAGGCTGACCAGGTGGAAGAGGCTCACAATCTCACGGTTCCTGGCAGCCTGCGTTCCATGGAAATCCCAGGCCTCAGGGCTGGCACTCCTTACACAGTCA |
| 2042 | TNC | 3222215 | GAAGGGGCCTATGAGTACTTTTTCATTCAGGTGCAGGAGGCTGACACAGTAGAGGCAGCCCAGAACCTCACCGTCCCAGGAGGACTGAGGTCCACAGACCTGCCTGGGCTCAAAGCAGCCACTCATTATACCATCACCATCCGCGGGGTC |
| 2043 | TNC | 3222216 | GCTGACCAGGCCTATGAGCACTTTATCATTCAGGTGCAGGAGGCCAACAAGGTGGAGGCAGCTCGGAACCTCACCGTGCCTGGCAGCCTTCGGGCTGTGGACATACCGGGCCTCAAGGCTGCTACGCCTTATACAGTCTCCATCTATGGGGTGATCCAGGGCTATAGAACACCAGT |
| 2044 | TNC | 3222219 | CTGCTCTGGAAGACACCGTTGGCCAAATTTGACCGCTACCGCCTCAATTACAGTCTCCCCACAGGCCAGTGGGTGGGAGTGCAGCTTCCAAGAAACACCACTTCCTATGTCCTGAGAGGCCTGGAACCAGGACAGGAGTACAATGTCCTCCTGACAGCCGAGAAAGGCAGACACAAGAGCAAGCCCGCACGTGTGAAGGCATCCA |
| 2045 | TNC | 3222220 | CTGAGGCCGGGAACTGAATATGGGATTGGAGTTTCTGCTGTGAAGGAAGACAAGGAGAGCAATCCAGCGACCATCAACGCAGCCAC |
| 2046 | TNC | 3222221 | CCAGACAGATAACAGCATCACCCTGGAATGGAGGAATGGCAAGGCAGCTATTGACAGTTACAGAATTAAGTATGCCCCCATCTCTGGAGGGGACCACGCTGAGGTTGATGTTCCAAAGAGCCAACAAGCCACAACCAAAA |
| 2047 | TNC | 3222222 | CCCAGCCAGATCGAGGTGAAAGATGTCACAGACACCACTGCCTTGATCACCTGGTTCAAGCCCCTGGCTGAGATCGATGGCATTGAGCTGACCTACGGCATCAAAGACGTGCCAGGAGACCGTACCACCATCGATCTCACAGAGGACGAGAACCAGTACTCCATCGGGAACCTGAAGCCTG |
| 2048 | TNC | 3222225 | AGGCCAGAGACCTCTTACCGGCAAACTGGTCTAGCTCCTGGGCAAGAGTATGAGATATCTCTGCACATAGTGAAAAACAATACCCG |
| 2049 | TNC | 3222226 | GATCCTCTAGACATTGCTTTTGAAA |
| 2050 | TNC | 3222227 | AATTCAAGTCCATCAAGGAGACATCTGT |
| 2051 | TNC | 3222228 | TGAGATGCGGGTCACAGAGTACCTTGTCGTGTACACGCCCACCCACGAGGGTGGTCTGGAAATGCAGTTCCGTGTGCCTGGGGACCAGACGTCCACCATCATCCAGGAGCTGGAGCCTGGTGTGGAGTACTTTATCCGTGTATTTGCCATCCTGGAGAACAAGAAGAGCATTCCTGTCAGCGCCA |
| 2052 | TNC | 3222229 | TTATGGGCAAAGACTGCAAGGAGCAAAGATGTCCCAGTGACTGTCATGGCCAGGGCCGCTGCGTGGACGGCCAGTGCATCTGCCACGAGGGCTTCACAGGCCTGGACTGTGGCCAGCACTCCTGCCCCAGTGACTGCAACAACTTAGGACAATGCGTCTCGGGCC |
| 2053 | TNC | 3222230 | TTGCTACAACCGTGGACGATGCGTGGAGAATGAGTGCGTGTGTGATGAGGGTTTCACGGGCGAAGACTGCAGTGAGCTCATCTGCCCCAATGACTGCTTCGACCGGGGCCGCTGCATCAATGGCACCTGCTACTGCGAAGAAGGCTTCACAGGTGAAGACTGCGGGAAACCCACCTGCCCACATGCCTGCCACACCCAGGGCCGGTGTGAGGAGGGGCAGTGTGTATGTGATGAGGGCTTTGCCGGTGTGGACTGCAGCGAGAAGAGGTGTCCTGCTGACTGTCACAATCGTGGCCGCTGTGTAGACGGGCGGTGTGAGTGTGATGATGGTTTCACTGGAGCTGACTGTGGGGAGCTCAAGTGTCCCAATGGCTGCAGTGGCCATGGCCGCTGTGTCAATGGGCAGTGTGTGTGATGAGGGCTATACTGGGGAGGACTGCAGCCAGCTACGGTGCCCCAATGACTGTCACAGTCGGGGCCGCTGTGTCGAGGGCAAATGTGTATGTGAGCAAGGCTTCAAGGGCTATGACTGCAGTGACATGAGCTGCCCTAATGACTGTCA |
| 2054 | TNC | 3222231 | CTGTGTCTGCGAACCTGGCTGGAAAGGCCCCAACTGCTCTGAGCCCGAATGTCCAGGCAACTGTCACCTTCGAGGCCGGTGCATTGATGGGCAGTGCATCTGTGACGACGGCTTCACGGGCGAGGACTGCAGCCAGCTGGCTTGCCCCAGCGACTGCAATGACCAGGGCAAGTGCGTAAATGGAGTCTGCATCTGTTTCGAAGGCTACGCCGGGGCTGACTGCAGCCGTGAAATCTGCCCAGTGCCCTGCAGTGAGGAGCACGGCACATGTGTAGATGGCTTGTGTGTGTGCCACGATGGCTTTGCAGGCGATGAC |
| 2055 | TNC | 3222234 | TCCTTGCCCTCGCTACCGAAGGTGGGGTCCTCAAGAAAGTCATCCGGCACAAGCGACAGAGTGGGGTGAACGCCACCCTGCCAGAAGAGAACCAGCCAGTGGTGTTTAACCACGTTTACAACATCAAGCTGCCAGTGGGATCCCAGTGTTCGGTGGATCTGGAGTCAGCCAGTGGGGAGAAAGACCTGGCACCGCCTTCAGAGCCCAGCGAAAGCTTTCAGGAGCACACA |
| 2056 | TNC | 3222235 | ATTCTGCTGAAAGTGAGATACCCTAGAGCCCTAGAGCC |
| 2057 | TNC | 3222248 | TTTCTATAGACACCTAGCTGTGCTTTCTTACAAGAAAACATATCCACTGGACCAAAG |
| 2058 | TNC | 3222253 | AACCGCCGCAGCTCCACACTCCAGGTACTTCTTCAAGGACCTAGGTCTCTCGCCCATCGGAAA |
| 2059 | TNC | 3222254 | CCCCGCCTCCGTGGGCACAAAGGCAGCGCTGCTGGGGAACTCGGGGGAACGCGCA |

TABLE 13-continued

Subtyping Target Sequences

| SEQ ID NO. | Gene | Affy Probeset ID | Sequence |
|---|---|---|---|
| 2060 | TNC | 3222255 | CGAGGCGTCCCATTACAGAGGAAGGAGCTCGCTATATAAGCCAGCCAAAGTTGGCTGCACCG GCCACAGCCTGCCTACTGT |
| 2061 | AKR1C2 | 3232993 | GGAACTGATCCTCAGACAAGCCAGGACTCAAGTACAAGCCCATCTACAACCAGATGAGCCCTT AGGGCCACT |
| 2062 | AKR1C2 | 3232994 | TTGTTCAGTATGTTGTGCTTTAATT |
| 2063 | AKR1C2 | 3232998 | GTAAGAAACGGTTGAACTGGATGCAATTTTTATCACAGCTTGTGTAAGACTGCCTCTGTCCCT CCTCTCACATGCCATTGGTTAACCAGCAGACAGTGTGCTCAGGGGCGTTGCCAGCTCATTGCTC |
| 2064 | AKR1C2 | 3233005 | GTTGGACTGGCCATCCGAAGCAAGATTGCAGATGGCAGTGTGAAGAGAGAAGACATATTCTA CACTTCA |
| 2065 | AKR1C2 | 3233006 | GCAATTCCCATCGACCAGAGTTGGTCCGACCA |
| 2066 | AKR1C2 | 3233007 | CCAGGTGAGGAAGTGATCCCAAAAGATGAAAATGGAAAAATACTATTTGACACAGTGGATCT CTGTGCCACATG |
| 2067 | AKR1C2 | 3233012 | TGGATTTCTGCAAGTCAAAAGACAT |
| 2068 | AKR1C2 | 3233013 | GAGGACCCAGTCCTTTGTGCCTTGGCAAAAAAGCACAAGCGAACCCCAGCCCTGATTGCCCT GCGCTACCAGCTACAGCGTGGGGTTGTGGTCCTGGCCAAGAGCTACAATGAGCAGCGCATCA GACAGAACGTG |
| 2069 | AKR1C2 | 3233018 | TAGATGGCCTAAACAGAAATGTGCG |
| 2070 | AKR1C2 | 3233020 | TTGCTGGCCCCCCTAATTATCCATTT |
| 2071 | AKR1C2 | 3233063 | GTTGGACTGGCCATCCGAAGCAAGATTGCAGATGGCAGTGTGAAGAGAGAAGACATATTCTA CACTTCA |
| 2072 | AKR1C2 | 3233074 | GAGGACCCAGTCCTTTGTGCCTTGGCAAAAAAGCACAAGCGAACCCCAGCCCTGATTGCCCT GCGCTACCAGCTGCAGCGTGGGGTTGTGGTCCTGGCCAAGAGCTACAATGAGCAGCGCATCA GACAGAACGTG |
| 2073 | AKR1C2 | 3233086 | GATTCACATCTTGGAGTAGTCACAACTTGCAGTGCCCTGATTGCTTCTATTTGCTT |
| 2074 | AKR1C2 | 3233127 | GAGAGAAGACATATTCTACACTTCAA |
| 2075 | AKR1C2 | 3233133 | ACAGTGCTCTGGGAACCCAACGACAT |
| 2076 | GATA3 | 3234279 | CCGGGGTGCCCATTGCGCAGAGCGTGGCCTGGAGACCCGCGAGCCGGGGAAGGTCGCCGTG GAGTCCCGACCAGAGGCCGGGGTTGGGGTCGGTGCAGACCGAGGGCTGGTTTCCTTGACTG TGGGAGAAACGCCGGGAGCCGG |
| 2077 | GATA3 | 3234281 | CTGGCGCCGTCTTGATACTTTCAGAAAGAATGCATTCCCTGTAAAAAAAAAAAAAAAATACTG AGAGAGGGAGAGAGAGAGAAGAAGAGAGAGACGGAGGGAGAGCGAGACAGAGCG AGCAACGCAATCTGACCGAGCAGGTCGTACGCCGCCG |
| 2078 | GATA3 | 3234282 | GTGACCCGAGGAGGGACTCCGCCTCCGAGCGGCTGAGGACCCCGGTGCAGAGGAGCCTGGC TCGCAGAATTGCAGAGTCGTCGCCCCTTTTTACAACCTGGTCCCGTTTTATTCTGCCGTACCCA GTTTTTGGATTTTTGTCTTCCCCTTCTTCTCTTTGCTAAACGACCCCTCCAAGATAATTTTTAAAA AACCTTCTCCTTTGCTCACCTTTGCTTCCCAGCCTTCCCATCCCCCCACCGAAAGCAAATCATTC AACG |
| 2079 | GATA3 | 3234283 | CGAGAGGGCGCGAGCACAGCCGAGG |
| 2080 | GATA3 | 3234284 | GAGGTGACGGCGGACCAGCCGCGCTGGGTGAGCCACCACCACCCCGCCGTGCTCAACGGGC AGCACCCGGACACGCACCACCCGGG |
| 2081 | GATA3 | 3234285 | ATGTGCTTTTTAACATCGACGGTCAAGGCAACCACGTCCCGCCCTACTACGGAAACTCGGTCA GGGCCACGGTGCAGAGGTACCCTCCGACCCACCA |
| 2082 | GATA3 | 3234286 | CCTACCCTGGCTGGACGGCGGCAAAGCCCTGGGCAGCCACCACACCGCCTCCCCCTGGAATC TCAGCCCCTTCTCCAAGACGTCCATCCACCACGGCTCCCCGGGGCCCCTCTCCGTCTACCCCCC GGCCTCGTCCTCCTCCTTGTCGGGGGGCCACGCCAGCCCGCACCTCTTCACCTTCCCGCCCACC CCGCCGAAGGACGTCTCCCCGGACCCATCGCTGTCCACCCCAGGCTCGGCCGGCTCGGCCCG GCAGGACGAGAAAGAGTGCCTCAAGTACCAGGTGCCCCTGCCCGACAGCATGAAGCTGGAG TCGTCCCACTCCCGTGGCAGCATGACCGCCCTGGGTGGAGCCTCCTCGTCGACCCACCACCCC ATCACCACCTACCCGCCCTACGTGCCCGAGTACAGCTCCGGACTCTTCCCCCCCAGCAGCCTGC TGGGCGGCTCCCCCACCGGCTTCGGATGCAAGTCCAGG |

TABLE 13-continued

Subtyping Target Sequences

| SEQ ID NO. | Gene | Affy Probeset ID | Sequence |
|---|---|---|---|
| 2083 | GATA3 | 3234291 | AGTGTGTGAACTGTGGGGCAACCTCGACCCCACTGTGGCGGCGAGATGGCACGGGACACTA CCTGTGCAACGCCTGCGGGCTCTATCACAAAATGAACGGACAGAACCGGCCCCTCA |
| 2084 | GATA3 | 3234293 | AGAGCAGGGACGTCCTGTGCGAACTGTCAGACCACCACAACCACACTCTGGAGGAG |
| 2085 | GATA3 | 3234298 | AGGCATCCAGACCAGAAACCGAAAAATGTCTAGCAAATCCAAAAAGTGCAAAAAAGTGCATG ACTCACTGGAGGACTTCCCCAAGAACAGCTCGTTTAACCCGGCCGCCCTCTCCAGACACATGT CCTCCCTGAGCCACATCTCGCCCTTCAGCCACTCCAGCCACATGCTGACCACGCCCACGCCGAT GCACCCGCCATCCAGCCTGTCC |
| 2086 | GATA3 | 3234299 | AGCCCTGCTCGATGCTCACAGGGCCCCCAGCGAGAGTCCCTGCAGTCCCTTTCGACTTGCATT TTTGCAGG |
| 2087 | GATA3 | 3234300 | GTGTCTGTGTTCCAACCACTGAATCTGGACCCCATCTGTGAATAAGCCATTCTGACTCATATCC CCTATTTAACAGGGTCTCTAGTGCTGTGAAAAAAAAAATGCTGAACATTGCATATAACTTATA TTGTAAGAAATACTGTACAATGACTTTATTGCATCTGGGTAGCTGTAA |
| 2088 | GATA3 | 3234301 | AAGAAGAAACTAGGTCTGATATTCAAATGGACAAACTGCCAGTTTTGTTTCCTTTCACTGGCC ACAGTTGT |
| 2089 | GATA3 | 3234302 | GTTCAAAGCTGTTGGCCTCTGCAAAGGAAATACCAGTTCTGGGCAATCAGTGTTACCGTTCAC CAGTTGCCGTTGAGGGTTTCAGAGAGCCTTTTTCTAGGCCTACATG |
| 2090 | GATA3 | 3234303 | TAGCTTCTAAGAGTCCGGCGGCATCTGTCTTGTCCCTATTCCTGCAGCCTGTGCTGAGGGTAG CAGTGTATGAGCTACCAGCGTGCATGTCAGCGACCCTGGCCCGACAGGCCACGTCCTGCAAT CGGCCCGGCTGCCTCTTCGCCCTGTCGTGTTCTGTGTTAGTGATCACTGC |
| 2091 | VIM | 3236965 | GCTAACAAAAAGTCCGCACATTCGAGCAAAGACAGGCTTTAGCGAGTTATTAAA |
| 2092 | VIM | 3236966 | GGCCCGACCGCACACAGCAAGGCGATGGCCC |
| 2093 | VIM | 3236967 | ACTGAGAACTAGCAGCGCGCGCGGAGCCCGCTGAGACTTGAATCA |
| 2094 | VIM | 3236968 | GAGCCCTCAATCGGCGGGACAGCAGGG |
| 2095 | VIM | 3236969 | CTTTCCTCTGCCACCGCCGTCTCGCAACTCCCGCCGTCCGAAGCTGGACTGAGCCCGTTAGGT CCCTCGACAGAA |
| 2096 | VIM | 3236971 | CCCGCGCCAGAGACGCAGCCGCGCTCCCACCACCCACACCCACCGCGCCCTCGTTCGCCTCTT CTCCGGGAGCCAGTCCGCGCCACCGCC |
| 2097 | VIM | 3236972 | TCCAGCCGGAGCTACGTGACTACGTCCACCCGCACCTACAG |
| 2098 | VIM | 3236973 | CTGGGCAGCGCGCTGCGCCCCAGCACCAGC |
| 2099 | VIM | 3236974 | GTGCGCCTGCGGAGCAGCGTGCCCG |
| 2100 | VIM | 3236975 | TGCAGGACTCGGTGGACTTCTCGCTGGCCGACGCCATCAACACCGAGTTCAAGAACACCCGC ACCAACGA |
| 2101 | VIM | 3236976 | GCAGGAGCTGAATGACCGCTTCGCCAACTAC |
| 2102 | VIM | 3236977 | CAGAATAAGATCCTGCTGGCCGAGCTCGAGCAGCTCAAGGGCCAAGGCAAGTCGCGCCTGG GGGACCTCTACGAGGAGGAGATGCGGGAGCTGCGCCGGCAGGTGGACCAGCTAACCAACG ACAAAGCCCGCGTCGA |
| 2103 | VIM | 3236978 | GTGGAGCGCGACAACCTGGCCGAGGAC |
| 2104 | VIM | 3236979 | AGGACGCTCCGTTTCAAGTTACAGATTTCTTAAAACTACCACTTTGTGTGCAGTTGAAGGCCCT TGGGCACAATGAGAGCCAGTCCTCCAAACTTTCAGAAAGTTTCCTGCCCCTTCTGGCAGGCTG CCAATCACCGGGCGGGAGAAGGAAGGAGGGGAAGGCGGTGGAGGGAGCGAGACAAAGGG ATGGTCCCTCGGGGCGGGATGGCGGGGCTGTCCTGTAGGTCTGTGCGGCCACCGTGATT GCCCCTCTGCGCGGTCCCGAAGTCCCGCTGAAACCTGCCGAGGGCAGCAGGTCTGAAAGCT GCAGGCGCTAGTTGCGCGGAGGTGGCGCAGCTGCTCTGGAGGCGCAGAGCGAATACGTGGT GTTTGGGTGTGGCCGCCCCGCCCCTGGCGGTTTCCTCGTTCCCCTTTGGTTAATGCGCAACTGT TTC |
| 2105 | VIM | 3236980 | CGAAAACACCCTGCAATCTTTCAGACAG |
| 2106 | VIM | 3236981 | CACAACCCACGAGCAATTCTAAAAGTTGCTTAACTCACGTCTAAAAAGTGCAAAACTTCAGGG CTGCGCGTAAAGCCCTCTAGTGGCGGGAAGACCACAGGT |

TABLE 13-continued

Subtyping Target Sequences

| SEQ ID NO. | Gene | Affy Probeset ID | Sequence |
|---|---|---|---|
| 2107 | VIM | 3236984 | CAGTCATGATTGAGTGCAGTTTACCATGTGTGTGGACATTTATTTATTTTAAAATTGTCTGATC ACCACCTTGAGTAAAACACAAGCAGTCACAATTAAAATATATTAGTGAGCAGGAGAAAGCAC AGCATATTATAGCACTGAATG |
| 2108 | VIM | 3236985 | TCATAAAATGTGTCAACGGCTTTTCTATA |
| 2109 | VIM | 3236986 | GTAAGGAGACTAGGTTCAGATGGTTAATCTAAGACAAATAAATGAGATAAGCCATACACTTTT ACATCCTCCATGTCCTGTCTTT |
| 2110 | VIM | 3236987 | GATGTTGACAATGCGTCTCTGGCACGTCTTGACCTTGAACGCAAAGTGGAATCTTTGCAAGA |
| 2111 | VIM | 3236988 | CAGGAACAGCATGTCCAAATCGATGTGGATGTTTCCAAGCCTGACCTCACGGCTGCCCTGCGT GACGTACGTCAGCAATATGAAAGTG |
| 2112 | VIM | 3236991 | CTCTGAGGCTGCCAACCGGAACAATGACGCCCTGCGCCAGGCAAAGCAGGAGTCCACTGAGT ACCGGAGACAGGTG |
| 2113 | VIM | 3236993 | GAGAACTTTGCCGTTGAAGCTGCTAACTACCAAGACACTATTGGCCGCCTGCAGGATGAGATT CAGAATATGAAGGAGGAAATGGCTCGTCACCTTCGTAATACCAAGACCTGCTCAATGTTAA GATGGCCCTTG |
| 2114 | VIM | 3236994 | CTCAGACTTGGATGCGTGAACTAATGGTGACCATTTGTTAGGCCCTGTGCCACTGGGCTCTAA GCAGTGTCACATTTAATCTTTAGAAAGTTTCTTTGAGGTAACTGCTTTCCACTTTTTGTAGAGG AGGAATTTGAATTGAGAGAGAGTAAGTGACTTGCTGAAAAAGGGTTAATCAACAGCAGAGCT GGGATTTGAACCCATAACTCTGTCAAAGCCTCCACTCCTAACTCCTGTTCATGCTCCTGTGGA |
| 2115 | VIM | 3236995 | GATTTCTCTGCCTCTTCCAAACTTTTCCTCCCTGAACCTGAG |
| 2116 | VIM | 3236996 | CTTTAGGAAAAACGTCAGCTGCTTGTAACCACTGTGTTTATGTCAAAGCATTCATTTTTTTAG GATATCTGAAAAAATGCCATATAAGAGAAAACTCTATAAAACATCTATAATTTTCGAACCCAA GTACACTCTTGCATTCTATGCTTTAAGTTAAATGCAAACTCCTTTTTCCTTCTTCCTGCTGCAAG TACTATCTCATCCTGATGCTCAAGAGTGTCAGGGCCTGGGTTTCCAAACAGAGACTACCCTAA AATTATTTGGCGAGTAGTACTTTACACAATTGC |
| 2117 | VIM | 3236999 | CTCAGCATCACGATGACCTTGAATAA |
| 2118 | VIM | 3237000 | CACTCAGTGCAGCAATATATTACCAGCA |
| 2119 | VIM | 3237001 | GCAGTTTTTCAGGAGCGCAAGATAGATTTGGAATAGGA |
| 2120 | VIM | 3237002 | TCTAGTTCTTAACAACCGACACTCCTACAAGATTTAGAAAA |
| 2121 | VIM | 3237003 | GTATTTTGAATACCATTAAAACTGC |
| 2122 | BAMBI | 3240453 | AGCTGCGGCGGATACCCTTGCGTGCTGTGGAGACCCTACTCTCTTCGCTGAGAACGGCCGCTA GCGGGGACTGAAGGCCGGGAGCCCACTCCCGACCCGGGGCTAGCGTGCGTCCCTAGAGTCG AG |
| 2123 | BAMBI | 3240454 | ATGGATCGCCACTCCAGCTACATCTTCATCTGGCTGCAGCTGG |
| 2124 | BAMBI | 3240461 | TTCGATGCTACTGTGATGCTGCCCACTGTGTAGCCACTGGTTATATGTGTAAATCTGAGCTCA GCGCCTGCTTCTCTAGACTTCTTGATCCTCAG |
| 2125 | BAMBI | 3240462 | TGCCTGGACTCTCTTGCAAGCACGACAGACATCTGCCAAGCCAAACAGGCCCGAAACCACTCT GGCACCACCATACCCACATTGGAATGCTGTCATGAAGACATGTGCAATTACAGAGGGCTGCA CGATGTTCTCTCTCC |
| 2126 | BAMBI | 3240463 | GCCTGCCTGATCTATAGACTTGTGACAGCCACGACTTTGTATGTCTGCTATTGATTTTGTTGTT AATGTAATTAGAGACACCAGAGGGAGAAGCCTGGCTGGATGCAAAGATGCATCTTGATTGAG TGGCTTTTATGTCTGAGCATTAGATGTCTGTC |
| 2127 | BAMBI | 3240464 | TTGCTTATTATGTTGGCCCTGAGGATGCTTCGAAGTGAAAATAAGAGGCTGCAGGATCAGCG GCAACAGATGCTCTCCCGTTTGCACTACAGCTTTCACGGACA |
| 2128 | BAMBI | 3240465 | GCAGACCTCAGCAACGATAAGATCCTCTCGCTTGTTCACTGGGGCATGTACAGTGGGCACGG GAAGCTGGAATTCGTATGA |
| 2129 | BAMBI | 3240466 | CGGAGTCTTATCTGAACTACACTTACTGAACAGCTTGAAGGCCTTTTGAGTTCTGCTGGACAG GAGCACTTTATCTGAAGACAAACTCATTTAATCATCTTTGAGAGACAAAATGACCTCTGCAAA CAGAATCTTGGATATTTCTTCTGAAGGATTATTTGCACAGACTTAAATCAGTTAAATGTGTTA TTTGCTTTTAAAATTATAAAAAGCAAAGAAGACTTTGTACACACTGTCACCAGGGTTATTT GCATCCAAGGGAGC |

TABLE 13-continued

Subtyping Target Sequences

| SEQ ID NO. | Gene | Affy Probeset ID | Sequence |
|---|---|---|---|
| 2130 | DDIT4 | 3251402 | GGTCCTAGAGCTCGCGGTCTGGTCTGGTCTGGTCCCCAGACTGACGCCTGGTCGGTCCCCCTCTT |
| 2131 | DDIT4 | 3251403 | GGCTTCTACGCTCCGGCACTCTGAGTTCATCAGCAAACGCCCTGGCGTCTGTCCTC |
| 2132 | DDIT4 | 3251404 | CTAGCCTTTGGGACCGCTTCTCGTCGTCGTCCACCTCCTCTTCGCCCTCGTCCTTGCCCCGAACTCCCACCCCAGATCGGCCGCCGCGCTCAGCCTGGGGGTCGGCGACCCGGGAGGAGGGGTTTGACCGCTCCACGAGCCTGGAGAGCTCGGACTGCGAGTCCCTGGA |
| 2133 | DDIT4 | 3251406 | TTGCCCGACTTCGAGCTGCTCAGTGACCCTGAGGATGAACACTTGTGTGCCAACCTGATGCAGCTGCTGCAGGAGAGCCTGGCCCAGGCGCGGCTGGGCTCTCGACGCCCTGCGCGCCTGCTGATGCCTAGCCAGTTGGTAAGCCAGGTGGGCAAAGAACTACTGCGCCTGGCCTACAGCGAGCCGTGCGGCCTGCGGGGGCGCTGCTGGACGTCTGCGTGGAGCAGGGCAAGAGCTGCCACAGCGTGGGCCAGCTGGCACTCGACCCCAGCCTGGTGCCCACCTTCCAGCTGACCCTCGTGCTGCGCCTGGACTCACGACTCTGGCCCAAGATCCAGGGGCTGTTTAGCTCCGCCA |
| 2134 | DDIT4 | 3251407 | CAGAGACGACTGAACTTTTGGGGTGGAGACTAGAGGCAGGAGCTGAGGGACTGATTCCTGTGGTTGGAAAACTGAGGCAGCCACCTAAGGTGGAGGTGGGGGAATAGTGTTTCCCAGGAAGCTCATTGAGTTGTGTGCGGGTGGCTGTGCATTGGGGACACATACCCCTCAGTACTGTAGCATGAAACAAAGGCTTAGGGGCCAACAAGGCTTCCAGCTGGATGTGTGTGTAGCATGTACCTTATTATTTTTGTTACTGACAGTTAACAGTGGTGTGACATCCAGAGAGCAGCTGGGCTGCTCCCGCCCCAGCCCGGCCCAGGGTGAAGGAAGAGGCACGTGCTCCTCAGAGCAGCCGGAGGGAGGGGGAGGTCGGAGGTCGTGGAGGTGGTTTGTGTATCTTACTGGTCTGAAGGGACCAAGTGTGTTTGTTGTTTGTTTTGTATCTTGTTTTTCTGATCGGAGCATCACTACTGACCTGTTGTAGGCAGCTATCTTACAGACGCATG |
| 2135 | DDIT4 | 3251408 | CACTTGAAAAATTACACCTGGCAGCTGCGTTTAAGCCTTCCCCCATCGTGTACTGCAGAGTTGAGC |
| 2136 | DDIT4 | 3251409 | CCTCCCCGGGAGGAGTGCCATCTGGGTCTTCCATCTAGAACTGTTTACATGAAGATAAGATACTCACTGTTC |
| 2137 | DDIT4 | 3251410 | TTCAAGTATTAAGACCTATGCAATATTTTT |
| 2138 | SNCG | 3256173 | CCGCAGCTCGCAGGGAGATCCAGCTCCGTCCT |
| 2139 | SNCG | 3256174 | GAAGGGCTTCTCCATCGCCAAGGAGGGCGTGGTGGGTGCGGTGGAAAAGACCAAGCAGGGGGTGACGGAAGC |
| 2140 | SNCG | 3256175 | GGTCTAGCCAGTGTCCCTACCTCAGGCCTGCTCTCTCTTGTCCCCCACATTCTGTCCTGTCCCCTTCCCATCCATCCACTTCTTCCAGACACAGCAGGAAGAGGCCCTCTGAAGGGGCCGCCGGCCCCCAGACACCATCCTTACCCCCCCACCGACCCCACAGTTTGTCCAGCTGTTCTGTTGTGTTTGTCCTGACCGCCCCCAACACCTCGAGGGAGGTCTGG |
| 2141 | SNCG | 3256178 | GGGCTGGGGTGGAGGCCAGCCAGTGTCC |
| 2142 | SNCG | 3256179 | AGGAGCAGGCCAACGCCGTGAGCGAGGCTGTGGTGAGCAGCGTCAACACTGTGGCCACCAAGACCGTGGAGGAGGCGGAGAACATCGCGGTCACCTCCGGGGTGGT |
| 2143 | SNCG | 3256183 | GACTTGAGGCCATCTGCCCCCCAACAGGAGG |
| 2144 | SNCG | 3256184 | GTGAGGCATCCAAAGAGAAAGAGGAAGTGGCAGAGGAG |
| 2145 | SNCG | 3256186 | GGCTACAGGCCAGCGTGGATGACCTGAAGAGCGCTCCTCTGCCTTGGACACCATCCCCTCCTAGCACAAGGAGTGCCCGCCTTGAGTGA |
| 2146 | SNCG | 3256187 | CCTCGTCTCCCTGGCCACCCTTGGCCTGTCCACCTGTGCTGCTGCACCAACCTCACTGCCCTCCCTCGGCCCCACCCACCCTCTGGTCCTTCTGACC |
| 2147 | INA | 3262137 | CGCACGTCCGGCCCCGATCCCGGCAC |
| 2148 | INA | 3262138 | ATGAGCTTCGGCTCGGAGCACTACCTGTGCTCCT |
| 2149 | INA | 3262139 | CCGCCTCTCTGGGGCCGGCGGCGCG |
| 2150 | INA | 3262140 | GGCGCGCACCAACGAGTACAAGATCATCCGCACCAACGAGAAGGAGCAGCTGCAGGGCCTCAACGACCGCTTCGCCGTGTTCATCGAGAAGGTGCATCAGCTGGAGACGCAGAACCGCGCGTTGGAGGCCGAGCTGGCCGCGCTGCGACAGCGCCACGCTGAGCCGTCGCGCGTCGGCGAGCTCTTCCAGCGCGAGCTGCGCGACCTGCGCGCGCAGCTGGAGGCCCAGCTCGGCTCGCTCGCAGGCCCTGCTGGAGCGCGACGGGCTGGCGGAGGAGGTGCAGCGGCTGCGGGCGCGCTGCGAGGAGGAGAGCCGCGGACGCGAAGGCGCCGAGCGCGCCCTGAAGGCGCAGCAGCGCGACGTGGACGCGCCACGCTGGCCCGCCTGGACCTGGAGAAGAAGGTGGAGTCGCTGCTGGACGAGCTGGCCTTCGTACGCCAGGTGCACGACGAGGAGGTAGCCGAGCTGCTGGCCACGCTGCAGGCGTCGTCGCAGGCCGCGGCCGAGGTGGACGTGACTGTGGCTAAACCAGACCTGACCTCGG |

TABLE 13-continued

Subtyping Target Sequences

| SEQ ID NO. | Gene | Affy Probeset ID | Sequence |
|---|---|---|---|
| | | | CTCTGAGGGAGATCCGCGCCCAGTATGAGTCCCTGGCCGCTAAGAACCTGCAGTCCGCGGAA GAATGGTACAAGTCCAAGTTTGCCAACCTGAACGAGCAGGCGGCGCGCAGCACCGAGGCCA TCCGGGCCAGCCGCGAGGAGATCCACGAGTATC |
| 2151 | INA | 3262146 | CACCAAGAGTGAGATGGCACGCCACCTTCGGGAATACCAGG |
| 2152 | INA | 3262149 | GACACGTTTTAGCACCAGTGGGTTAAGCATTTCGGGGCTGAATCCACTTCCCAATCCAAGTTA CCTGCTCCCACCTAGAATCCTCAGTGCTACAACCTCCAA |
| 2153 | INA | 3262150 | ATCCACTGGGCTATCACTTAAGAAAGAGGAGGA |
| 2154 | INA | 3262151 | GTAGCCTCTAAGAAAACCTCCCAGATAGGGGAAAGTTTTGAAGAAATATTAGAGGAGACAGT AATATCTACTAAGAAAACCGAGAAATCAAATAT |
| 2155 | INA | 3262152 | AGCTCACGCTTCACAGTGATCGATGATTCAGGTGCAGAGGAAGTACAAACTAAGGTGCTAAA TCTGCGATCATCGTCATTTGCTGTGAACTGAAATTAAAACTATTCATGCTACCCAGCCATTACC CAGCTAAATAATCTTACTCTAGATACCTAAAACATAAGATCACTGCCAGAGATAAACTAATGG TCCACACCCAATTCCACTCTGATAGAATTATTTCACAAATAATAGGTGTTTGTTTAATGGACAC TTTTCACCTCCTTCAATTCCATATATCCTTTTCTTCTATGTAGGAAAAAAATAGTCTAGTGTAGT ATTCTTCCCTTTTAAACACATTTTGGTTCTTCTCAAAAGAACTTACCCCCATTCGCGCTCTGCTC AGTGGGTAAAATTAGATGCATGTTGACCATGTCTATGATTCGTGTAATTACTTATCCCTGCCCA TTTCATATTCTTTCAATTCTGTAGGTTAAAAAAATGGCAGTGATGAATTTTAAGGGTTTCCCCC AACATATAAAATAATGCAAAGAATCCCTAGACTTTAGGCTTTCAGCTTACACAAATCTATTTAA TTAGGAAAAAAACTATTAAGGATGTAGCTTTTCACCTTTACTTTAGAAGCACAGTAAATATCCC AAACTGTGATGAAGCCGACCTTAGATTTA |
| 2156 | INA | 3262153 | ATGCCTTTTACGAGTGCTAAGTGTAGGATATTTTGTCACCAGAACACAATGCTACCGCCCCAA AGTAAAAGAAACCACTTCTGGTCAATCAACACTACCAGCGTATATATAAGAAAGACATCTTTC TCTTTTTCTAAAAGACTTCCCTAACACTTACCCCATGGCTGCACAGTTGGTGGGGTCCTGCCGGA GAGGAAGAGACACTCAGACCAGAGAAGGGGTGTGCATGCGCCTACTCGCTTGCTA |
| 2157 | INA | 3262154 | GCCCAACTGTGTAGCATCTGCATTGCCCAGTCTTTCATGTGTGCCAAGGCTGATGCAGGATTT GTTCTCTGTCCAGCAGTCACTTCGGCCAGAGCTGAAGAGTTGCCC |
| 2158 | ACSL5 | 3264338 | ACAAGTGTTTGAACAGGTAACTTCTACCTTTGAA |
| 2159 | ACSL5 | 3264339 | ATTCAAAGGTTCCAGGGGAGTGTGTTGGCCACTCTCAG |
| 2160 | ACSL5 | 3264340 | ACAGTACACAGTAGCTTCGGGTGTGTCCCAGTCAGTCCTAGGAGCTGTGGAAAGAGTAGAAG TGCCTGAATGTGGTGCTGA |
| 2161 | ACSL5 | 3264341 | CAGAGGATGGAATGCCACAGGCCCCACTTCGTCTCCCAGCCCTTCATCTTTCTTCCATGTCCAA AGGCGGCTCCCCAGAGGCCAAGGGCTCAGCTCTTGTGTTCTCTGAGA |
| 2162 | ACSL5 | 3264342 | AGCTTTTAAGAACTGCTCTGTAGAAAGAACAAACCCTAATCTAGCTCCAGCAAAGAGCCAGG ATCATGCTGAACTTCCTGTGAGCCTTCGTG |
| 2163 | ACSL5 | 3264344 | CCAGGAAGTGAAGTCCCCGAGCACGTTAGAAAGCCTGACATGGCCTGACTCGGGACAGCTCA GAGCAGGGCAGAACTGGGGACACTCTGGGCCGGCCTTCT |
| 2164 | ACSL5 | 3264345 | ATGGACGCTCTGAAGCCACCCTGTCTCTGGAGGAACCACGAGCGAGGGAAGAAGGACAGGG ACTCGTGTGGCAGGAAGAACTCAGAGCCGGGAAGCCCCCATTCACTAGAAGCACTGAGAGAT GCGGCCC |
| 2165 | ACSL5 | 3264352 | GTCTGAATTTCCTGCTGCTGTTCACAAAG |
| 2166 | ACSL5 | 3264353 | CGGCGTTGATCTGCATCCTGACATTTGGAGCTGCCATCTTCTTGTGGCTGATCACCAGACCTCA ACCCGTCTTACCTCTTCTTGACCTGAACAATCAGTCTGTGGGAATT |
| 2167 | ACSL5 | 3264358 | CAATGGGCCCTGCTTGGGATATAGAAAACCAAACCAGCCCTACAGATGG |
| 2168 | ACSL5 | 3264359 | GTGTCTGATAGAGCAGAGTACCTGGGTTCCTGTCTCTTGCATAAAGGTTATAAATCATCACCA GACCAGTTTGTCGGCATCTT |
| 2169 | ACSL5 | 3264361 | GGATCATCTCCGAATTGGCTTGTTACACGTACTCTATGGTAGCTGTACCTCTGTATGACACCTT GGGACCAGAAGCCATCGTACATA |
| 2170 | ACSL5 | 3264363 | CATGGTGATCTGTGACACACCCCAAAA |
| 2171 | ACSL5 | 3264367 | CTCCTAGCCCAGAAGACCTGAGCGTCATCTGCTTCACCAGTGGGAC |
| 2172 | ACSL5 | 3264368 | GCTACCTATTAGCTACATAAAGTATCT |
| 2173 | ACSL5 | 3264369 | CCAAAGGAGCCATGATAACCCATCAAAA |

TABLE 13-continued

Subtyping Target Sequences

| SEQ ID NO. | Gene | Affy Probeset ID | Sequence |
|---|---|---|---|
| 2174 | ACSL5 | 3264371 | TGTGGAGCCAGAGTTGGATTCTTCCAAGGGGATATTCGGTTGCTGGCTGACGACATGAAGAC TTTGAAGCCCACATTGTTTCCCGCGGTGCCTCGACTCCTTAACAGGA |
| 2175 | ACSL5 | 3264373 | AGGGTATCATCAGGCATGATAGTTTCTGGGACAAGCTCATCTTT |
| 2176 | ACSL5 | 3264374 | GGCGGAAGGGTTCGTGTAATTGTCACTGGAGCTGCCCCCATGTCCACTTCAGTCATGACATTC TTCCGGGCAGCA |
| 2177 | ACSL5 | 3264376 | TCACGTTGGGGTGCCCCTGGCTTGCAATTACGTGAAGCTGGAAGATGTGGCTGACATGAACT ACTTTACAG |
| 2178 | ACSL5 | 3264378 | TGAAGATCATCGACCGTAAAAAGAACATTTTCAAGCTGGCCCAAGGAGAATACATTGCACCA GAGAAGATAGAAAATATCTACAACAGGAGTCAACCAGTGTTACAAATTTTTGTACACG |
| 2179 | ACSL5 | 3264379 | GGTTCCTGACACAGATGTACTTCCCTCATTTGCAGCCAAGCTTGGGGTGAAGGGCTCCTTTGA GGAACTGTGCCAAAACCA |
| 2180 | ACSL5 | 3264380 | TGTAAGGGAAGCCATTTTAGAAGACTTGCAGAAA |
| 2181 | ACSL5 | 3264382 | TTCATCCAGAGCCATTTTCCATTGAAAATGGGCTCTTGACACCAACATTGAAAGCAAAGCGAG GAGAGCTTTCCAAATACTTTCGGACCCAAATTGACAGCCTGTATGAGCACATCCA |
| 2182 | ACSL5 | 3264383 | AGTACCTGCCGGCCCACTGTGCACTGCTTGTGAGAAAATGG |
| 2183 | ACSL5 | 3264384 | AACCTGTTAAACTCTAAAGCCATAGCTTTTGTTTTATATTGAGACATATAATGTGTAAACTTAGT |
| 2184 | ACSL5 | 3264385 | TTCAGGGCTACTTTTATCAACATGCCTGTCTTCAAGATCCCAGTTTATGTTCTGTGTCCTTCCTC ATGATTTCCAACCTTAATACTATTAGTAACCACAAGTTCAAGGGTCAAAGGGACCCTCTGTGC CTTCTTCTTTGTTTTGTGATAAACATAACTTGCCAACAGTCTCTATGCTTATTTACATCTTCTACT GTTCAAACTAAGAGATTTTTAAATTCTGAAAAACTGCTTACAATTCATGTTTTCTAGCCACTCC ACAAACCACTAAAATTTTAGTTTTAGCCTATCACTCATGTCAATCATATCTATGAGACAAATGT CTCCGATGCTCTTCTGCGTAAATTAAATTGTGTACTGAAGGGAAAAGTTTGATCATACCCAAAC ATTTCCTAAACTCTCTAGTTAGATATCTGACTTGGGAGTATTAAAAATTGGGTCTATGACATAT TGTCCAAAAGGAATGCTGTTCTTAAAGCATTATTTACAGTAGGAACTGGGGAGTAAATCTGTT CCCTACAGTTTGCTGCTG |
| 2185 | ACSL5 | 3264386 | CTGTGAAGGAACCAACTGATCTCCCCCACCCTTGGATTAGAGTTCCTGCTCTACCTTACCCACA GATAACACATGTTGTTTC |
| 2186 | BTBD16 | 3268223 | AGCTCCCCCTGTCAAAGCACCTTGGCCCATAAGAAGAAAAGGGGGAGCCCCAGATGTGATGA GCGCTTCCAGGCTTCAGGCTCAGAAGGCGCCCCCAGCTCTCCTGTAACTCAGAGGCCAGTGT GATGGGAGTTCCTCCACTCAGCACACTTCCCCTGTAAACACGCCTGTGGTGGGCAAAAGG |
| 2187 | BTBD16 | 3268224 | TTTCTCTCCTGCGTAATTTCCACTTTC |
| 2188 | BTBD16 | 3268226 | TCACTGGCTCAACCAACCGGTGGCGTTTGCCCAAACAGCCTTTCTCTGGGGACCTGCTCTCACT TTCCCAGATGTGCAAGGCTCTGAGCATAGACTTTGAGGAAGCT |
| 2189 | BTBD16 | 3268229 | ACAAGGACATCCAAAGTGGGGAAGCA |
| 2190 | BTBD16 | 3268231 | ATGTGATTCTCGAGTGCCTGGGCTTCAAATGGGAGCTCCATCAGCCCCAGCTTTTTCAGTCTG AGACCTTGGCCAAGCTCTACCTGAAAGCCCTGGCGCA |
| 2191 | BTBD16 | 3268236 | CACGGCCCTGAAGAACCTCTACATGAGTGAGGTGGAGATTAACTTGGAAGACCTACTGGGAG TGCTGGCTTCCGCCCACATCCTCCAG |
| 2192 | BTBD16 | 3268238 | AGCAGCTCACCACCGGCTGCGAGAAGTGGCTGGAAATGAACTTGGTTCCTCTAGGGGGGAC GCAGATCCACCTCCACAAAATCCCACAGGACCTGCTCCACAAAGTGCTG |
| 2193 | BTBD16 | 3268241 | GCTTTTGTGGGTCTTCTTGCAACTGAACTACAAGATTCAGGCAATTCCGACTTATGAAACCGT GATGACATTTTT |
| 2194 | BTBD16 | 3268245 | CTTTCCTGAGAACTGTTGCTTTCTGGACCGGGACATAG |
| 2195 | BTBD16 | 3268246 | TCTTCCTCTGCTTGCGTCTGCACGGCATCAC |
| 2196 | BTBD16 | 3268248 | GGGGCGACATGGTCCACCTGAAAGATCTTAACACCCAG |
| 2197 | BTBD16 | 3268249 | GAGAATACAACTTATTCGAAAACGATTGCTCTATATGGATTCTTCTTTAAGATAAAGGGACTC AAACATGATACTACCTCTTATAG |
| 2198 | BTBD16 | 3268250 | GGAATCTCCCTCTGCGGTCTACGAGCACAACCACGTCAGCCTGCGAGCGGCACGCCT |

TABLE 13-continued

Subtyping Target Sequences

| SEQ ID NO. | Gene | Affy Probeset ID | Sequence |
|---|---|---|---|
| 2199 | BTBD16 | 3268251 | GCAGAGGCCCTGGTTGACGGCAAGTGGC |
| 2200 | BTBD16 | 3268252 | AAAATCCAAACTGTGGGCATCCCAATCTATGTAAGTTTTGCATTC |
| 2201 | BTBD16 | 3268253 | CCAGAAGAATCTATGGGATTTTCCCCCCACTGGTCTGCATAAAAGAAAATAA |
| 2202 | AKR1C2 | 3274763 | TCTCTCCTGCTTGGCGACTTCAGTAAGCTACAGCTAAGCCCATCGGCCGGAAAAGAAAGACAATA |
| 2203 | AKR1C2 | 3274764 | TGAGGTCTGCCAGAAGGCCCTGCGTG |
| 2204 | AKR1C2 | 3274765 | TTGCTGGCCCCCCTAATTATCCATTT |
| 2205 | AKR1C2 | 3274771 | GAGGACCCAGTCCTTTGTGCCTTGGCAAAAAGCACAAGCGAACCCCAGCCCTGATTGCCCTGCGCTACCAGCTGCAGCGTGGGGTTGTGGTCCTGGCCAAGAGCTACAATGAGCAGCGCATCAGACAGAACGTG |
| 2206 | AKR1C2 | 3274772 | GGTTGCCTATAGTGCTCTGGGATCC |
| 2207 | AKR1C2 | 3274773 | CCAACTTCAACCACAGGCTGCTGGA |
| 2208 | AKR1C2 | 3274775 | GTGAGGAAGTGATCCCAAAAGATGAAAATGGAAAAATACTATTTGACACAGTGGATCTCTGTGCCACATGGGA |
| 2209 | AKR1C2 | 3274776 | GGAGCGCTGCATCACCTACCTCATG |
| 2210 | AKR1C2 | 3274777 | GCAATTCCCATCGACCAGAGTTGGTCCGACCAGCCTTGGAAAGGTCA |
| 2211 | AKR1C2 | 3274778 | GAGAGAAGACATATTCTACACTTCAA |
| 2212 | AKR1C2 | 3274779 | AAAGTAAAGCTCTAGAGGCCGTCAAATTGGCAATAGAAGCCGGGTTC |
| 2213 | AKR1C2 | 3274782 | CAGTGTGTGAAGCTGAATGATGGTCACTTCATGCCTGTCCTGGGATTTGGCACCTATGCGCCTGCA |
| 2214 | AKR1C2 | 3274783 | GGAGGAAGAAACATTTGCTAACCAGGCCAGTGACAG |
| 2215 | AKR1C2 | 3274784 | GTAAGAAACGGTTGAACTGGATGCAATTTTTATCACAGCTTGTGTAAGACTGCCTCTGTCCCTCCTCTCACATGCCATTGG |
| 2216 | AKR1C2 | 3274785 | TGTGCTATCCCTATGTGTATTGATTAT |
| 2217 | AKR1C2 | 3274786 | TGCGATGGTGCAATCCCAACTCACTG |
| 2218 | AKR1C2 | 3274787 | ACCATTGGAATGACATACTGCATCCTATAGTTATACCATCCAC |
| 2219 | AKR1C2 | 3274788 | AGCCCTAGCCAACGCCGCATGAGAGGGAGTGTGCCGAGGGCTTCTGAGAAGGTTTCTCTCACATCTAGAAAGAAGCGCTTAAGATGTGGCAGCCCCTCTTCTTCAAGTGGCTCTTGTCCTGTTGCCCTGGGAGTTCTCAAA |
| 2220 | AKR1C2 | 3274789 | TGCCAGCCAAGTGAAGACATGCTTACTTCCC |
| 2221 | AKR1C2 | 3274800 | GATTCACATCTTGGAGTAGTCACAACTTGCAGTGCCCTGATTGCTTCTATTTGCTT |
| 2222 | AKR1C2 | 3274814 | GTGGGGCAGGACATCGAAGATATCATTGACTCATCACATTCCCCTGAATAGCTCATATTTAGAAAATATTCTTAGATTGTAAAAATGTACTGTTCATTTGTTATATGCAATCTTTTAAATGTTTTATACTTTAAACAAGGCATAGTTACAAGTATAAAACATAAATATCCCAAAGCCATTATGCATGGCACTCAAGATTAAAATGGGAAATAATACATCTAATAAATCAAATGTTCCAAGACTTCAAATGTCTTTTGGAAACAGGCTATGTAAAACAGCACACTGGTTTCAAACTTTGGTAAATTTTAAGAAGAACTCTTACAAAGGCATTTAATTCTTATACATAATTTTCAGGGGAACTAATCAAATCAGCTAATCATGAAGACATGATTTTCGTTTTAGAAAACACTTTTGAAAACTTGGGATAATCTCATGTCTTAATGATCAAAGCATTATGAGAAGGACAGTGGTTTTTACCTGGGCACACTTTCTAACACATTTACTCTCCACTATTCGTACTCTGGTAGCCATGTTAACCCCATCAGAGATTCCTTCTCAAGCCATGTCTCAGAGCTGATAGGCATCCCAGCAAGTTTTGCAGCTCACAATTTTCTGTAAATTACTTATTCTATAAAATTGGAAGAGGCCATAAACTTTGGAGGGCCCTAGACCAATTTTTTGGATTATTTCTGGTCTACTCTCATTCCGTTGATGATCTTAGATATTCTCTGCATTAAATATCACCTCTAGGCTGAGAAATCCACCAAAAAATATTTCTAGCTCAGCGTTTTCCTCCAAATCTTC |
| 2223 | AKR1C2 | 3274820 | TTGTTCAGTATGTTGTGCTTTAATT |
| 2224 | AKR1C2 | 3274821 | TGCAGGTTTAACCAGGTCCATCAGG |
| 2225 | AKR1C2 | 3274822 | ACTCTCTTGGAGGTAATAGCTGCAAGAACTCTCCCAACAGGGACTTCTGTGCAAAAGGCTGAGTAAATTGCCCTTATGAGAGCCTT |

TABLE 13-continued

Subtyping Target Sequences

| SEQ ID NO. | Gene | Affy Probeset ID | Sequence |
|---|---|---|---|
| 2226 | AKR1C2 | 3274831 | AAAGCCATTGACAGCCTCAACGGAAATCTCCGACATGCTAAGTTAC |
| 2227 | AKR1C2 | 3274832 | GGCTGTGGTCCTGGTCAAGAGCTCCAATGAACAGCAGATCA |
| 2228 | AKR1C2 | 3274835 | ACAGTGCTCTGGGAACCCAACGACAT |
| 2229 | AKR1C2 | 3274836 | GATTCTGCTCATTTATACAATAATGAGGAG |
| 2230 | ACTA2 | 3299507 | TCCAAATCATTCCTAGCCAAAGCTCTGACTCGTTACCTATGTGTTTT |
| 2231 | ACTA2 | 3299508 | TCAGCAAACAGGAATACGATGAAGCCGGGCCTTCCA |
| 2232 | ACTA2 | 3299513 | GGCATCCATGAAACCACCTACAACAGCATCATGAAGTGTGATATTGACATCAGGAAGGACCTCTATGCTAACAATGTCCTATCAGGGGGCACCACTATGTAC |
| 2233 | ACTA2 | 3299517 | TCATCCTCCCTTGAGAAGAGTTACGAGTTGCCTGATGGGCAAGTGATCACCATCGGAAATGAACGTTTCCGCTGCCCAGAGACC |
| 2234 | ACTA2 | 3299520 | CTGGCTGGCCGAGATCTCACTGACTACCTCATGAAGATCCTGACTGAGCGTGGCTATTCCTTCGTTACTACTG |
| 2235 | ACTA2 | 3299521 | ATGTATGTGGCTATCCAGGCGGTGCTGTCTCTATGCCTCTGGACGCACAACT |
| 2236 | ACTA2 | 3299527 | CTCTTTCTACAATGAGCTTCGTGTTGCCCCTGAAGAGCATCCCACCCTGCTCACGGAGGCACCCCTGA |
| 2237 | ACTA2 | 3299530 | CAGGATGCATAATCCCTGTGTTCTCTGATACAGAACACCACACTACTGCTGGGGAAATAACTGGCTCACATTGCTCAACTGTACTTTTACTTG |
| 2238 | ACTA2 | 3299531 | ACAGCTACGTGGGTGACGAAGCACAGAGCAAAAGAGGAATCCTGACCCTGAAGTACCCGATAGAACATGGCATCAT |
| 2239 | ACTA2 | 3299534 | TGGGCTCTGTAAGGCCGGCTTTGCTGGGGACGATGCTCCCAGGGCTGTTTTCCCATCCATTGTGGGACGTCCCAGACATCA |
| 2240 | IFITM2 | 3315664 | GAACCACATTGTGCAAACCTTCTCTCCTGTCA |
| 2241 | IFITM2 | 3315665 | AGCAGGAAGTGGCTATGCTGGGGGTGC |
| 2242 | IFITM2 | 3315671 | TGGGCCCTGATTTTGGGCATCTTCATGACCATTCTGC |
| 2243 | IFITM2 | 3315672 | GTTGGTCGTCCAGGCCCAGCGATAG |
| 2244 | IFITM2 | 3315673 | CGTGACCTGTATCCCACGTACTCTATCTTCCATTCCTCGCCCTGCCCCCAGAGGCCAGGAGCTCTGCCCTTGACCTGTATTCCACTTACTCCAC |
| 2245 | IFITM2 | 3315674 | GAGTCCTGCATCAGCCCTTTATCCTCACACGCT |
| 2246 | IFITM2 | 3315678 | TTGGGGCAGGAAACTTTGGCCACCAGGCCTCTGACCTGCACCAGGAGACACTGGGAGGTTTAGTCCCCAAACCCGCACAGAGCAGGACTGCAGCCTG |
| 2247 | IFITM2 | 3315679 | TTAAACCACACCTCATTGGTCCCTGGCTAATTCACCAATTTAC |
| 2248 | IFITM2 | 3315680 | GTCTCACTGAGCACCGTCCCAGCATCCGGACACCACAGCGGCCCTTCGCTCCACGCAGAAAACCACACTTCTCAAACCTTCACTCAACACTTCC |
| 2249 | IFITM2 | 3315681 | ATCCTTCCAAGGTCCACCGTGATCAACATCCACAGCGAGACCTCCGTGCCCGACCATGTCGTCTGGTCCCTGTTCAACACCCTCTTCTTGAACTGGTGCTGTCTGGGCTTCATAGC |
| 2250 | IFITM2 | 3315684 | ATCCTCATGACCATTGGATTCATCCTGTTACTG |
| 2251 | IFITM2 | 3315685 | GTATTCGGCTCTGTGACAGTCTACCATATTATGTTACA |
| 2252 | IFITM2 | 3315686 | TAGCCGCCCATAGCCTGCAACCTTTGCACTCCACTGTGCAA |
| 2253 | IFITM2 | 3315687 | TTGGTCCTGCCCCTAGATACAGCAGTTTATACCCACACACCTGTCTACAGTGTCATTCAATAAAG |
| 2254 | SAA1 | 3322701 | TAAATAGCAGCCACCGCTCCCTGGCA |
| 2255 | SAA1 | 3322709 | GAGAATATCCAGAGATTCTTTGGCCATGGT |
| 2256 | SAA1 | 3322710 | ATCTGGCTGTGAGGCCCTCAGGGCAGGGATACAAAGCGGGGAGAGGGTACACAATGGGTATCTAATAAATACT |

TABLE 13-continued

Subtyping Target Sequences

| SEQ ID NO. | Gene | Affy Probeset ID | Sequence |
|---|---|---|---|
| 2257 | EHF | 3326462 | GGCTCAGACTTGATAACACCCGTGGTGCCCCATCCCTATAGGAGCTGGTGAGATTGCAGCCT GCTGCCTCCCCTCCAACAGCCACAGCTATTGGATTTCCCACCCAGAA |
| 2258 | EHF | 3326477 | GTGCTGCCACCAGCTTGGATTTTCATTGTTTGAAATTGCACTTTAAATACTTTA |
| 2259 | EHF | 3326479 | GAAGGAGGTGGTGTAATGAATCTCAACCCCGGCAACAACCTCCTTCACCAGCCGCCAGC |
| 2260 | EHF | 3326483 | ACCAACCAGCTGGATGCCAATTGTATCCCTTTCCAAGAGTTCGACATCAACGGCGAGCACCTC TGCAGCATGAGTTTGCAGG |
| 2261 | EHF | 3326485 | GCCAGTGCAGTAGTGACCTGTTCCAGTCCACACACAATGTCATTGTCAAGACTGAACAAACT |
| 2262 | EHF | 3326488 | TGGACAGCAAAACTTTCTGCCGGGCTCAGATCTCCATGACAAC |
| 2263 | EHF | 3326491 | TGAAAAAGGAGCAAGACCCCCCTGC |
| 2264 | EHF | 3326493 | CGAGAGGGACTCACTTATGGGAATTCATCCGCGACATCCTCTTGAACCCAGACAAGAACCCA GGATTAATAAAATGGGAAGACCGATCTGAGGGCGTCTTCAGGTTCTTGAAATCAGAGGCAGT GGCTCAGCTATGGGTAAAAAGAAGAACAACAGCAGCATGACCTATGAAAAGC |
| 2265 | EHF | 3326494 | ATTCTGGAGCGTGTGGATGGACGAAGACTGGTATATAAAT |
| 2266 | EHF | 3326495 | CAAAGAACTCCTGGACGTAAATATTTCAAAGACTACTTTTCTCTGATATTTATGTACCATGAG |
| 2267 | EHF | 3326496 | CAAGGTTGGCTATAATCTCTGCATAACCACATGACTTGGAATGCTTAAATCAGCAAGAAGAAT AATGGTGGGGTCTTTATACTCATTCAGGAATGGTTTATCTGATGCCAGGGCTGTCTTCCTTTCT CCCCTTTGGATGGTTGGTGAAATACTTTAATTGCCCTGTCTGCTCACTTCTAGCTATTTAAGAG AGAACCCAGCTTGGTTCTTTTTTGCTCCAAGTGCTTAAAAATAAGTTGGAAAAAGGAGACGGT GGTGTGGAAATGGCTGAAGAGTTTGCTCTTGTATCCCTATAGTCCAAGGTTTCTCAATCTGCA CAATTGACATTTTTGGCCGGAGTGTTCTTTGTGGTGAGGGCTTTCCTGTGCATTGTAAGATGTT CAGCAGTATCCACTCATGGTCTCTAACCACTTGACACCAGAAACCCCCCAGCTGTGATAACGC AAAATGTCTCTAGACATCACCAAATGTTCCCTGGGGGTGGCAAATTTGCCCTTGATTGAGAAC CACCAGTTTAGCTAGTCAATATGAGGATGGTGGTTTATTCTCAGAAGAAAAGATATGTAAG GTCTTTTAGCTCCTTAGAGTGAAGCAAAAGCAAGACTTCAACCTCAACCTATCTTTATGTTTTA AATGTTAGGGACAATAAGTTGAAATAGCTAGAGGAGCTTCTTTTCAGAACCCCAGATGAGAG CCAATGTCAGATAAAGTAAGCATAGTAATGTAGCAGGAACTACAATAGAAGACATTTTCACTG GAATTACAAAGCAGAATTAAAATTATATTGTAGAAGGAAACACCAAGAAAAGAATTTCCAGG GAAAATCCTCTTTGCAGGTATTAATTCTTATAATTTTTTGTCTTTTGGATTATCTGTTTACTGTCT CATCTGAACTGATCCCAGGTGAACGGTTTATTGCCTAGATTTGTACTCAGAGGAATTTTTTTTG TTTTGTTTTGTCTTTTAAGAAAGGAAAGAAAGGATGAAAAAATAAACAGAAAACTCAGCTCA GGCACAATTGTCACCAAGGAGTTAAAAGCTTCTTCTTCAATAGAGGAATTGTTCTGGGGGTCC TGGAGACTTACCATTGAGCCATGCAATCTGGGAAGCACAGGAATAAGTAGACACTTTGAAAA TGGATTTGAATGTTCTCATCCCTTTTGCAGCTTTTCTTTTTGGCTCTCTCATGTCCTTGGCTTGCT CCTCTATTCTA |
| 2268 | EHF | 3326497 | CATGTATCCATAAGAAGGAGTGCTCTTCATCAACTAATAGAGCACCTACCACAGTGTCAT |
| 2269 | CD44 | 3326636 | CCCGATTATTTACAGCCTCAGCAGAGCACGGGGCGGGGGCAGAGGGGCCCGCCCGGGAGG GCTGCTACTTCTTAAAACCTCTGCGGGCTGCTTAGTCACAGCCCCCCTTGCTTGGGTGTGTCCT TCGCTCGCTCCCTCCCTCCGTCTTAGGTCACTGTTTTCA |
| 2270 | CD44 | 3326637 | TGGACAAGTTTTGGTGGCACGCAGCCTGGGGACTCTGCCTCGTGCCGCTGAGCCTGGCGCAG AT |
| 2271 | CD44 | 3326652 | ATTTGAATATAACCTGCCGCTTTGCAG |
| 2272 | CD44 | 3326653 | AATGGTCGCTACAGCATCTCTCGGACGGAGGCCGCTGACCTCTGCAAGGCTTTCAATAGCACC TTGCCCACAATGGCCCAGATGGAGAAAGCTCTGAGCATCGGATTTGAGACCTG |
| 2273 | CD44 | 3326654 | GTAAGAGACCAGCACCCGACCACTGGGGAAAGCTGGCGGCCTGGGACCAGGCAGCTGGGCT TAGAACTGGAAGGCTCCTTTCCCACAGCTGAATGGATTATTGCCTAAGGAGTCAACCCCACGT ATTAATTTGGCCAAGTCAATCTGCAACCTGTATGACAACTGGAGTTTAAAGTCAGCTAAAGAC ACCTTTGTGAATCATAGAGCGGGAACCCAGAGGAAGCCATTAGGGGTCCTCTCGGCTGGAAT CCTCTTGT |
| 2274 | CD44 | 3326658 | AGGGCACGTGGTGATTCCCCGGATCCACCCCAACTCCATCTGTGCAGCAAACAACACAGGGG TGTACATCCTCACATCCAACACCTCCCAGTATGACACATATTGCTT |
| 2275 | CD44 | 3326666 | TATTGTTAACCGTGATGGCACCCGCTATGTCCAGAAAGGAGAATACAGAACGAATCCTGAAG ACATCTACCCCAGCAACCCTACTGATGATGA |
| 2276 | CD44 | 3326667 | CAGCGGCTCCTCCAGTGAAAGGAGCAGCACTTCAGGAG |

TABLE 13-continued

Subtyping Target Sequences

| SEQ ID NO. | Gene | Affy Probeset ID | Sequence |
|---|---|---|---|
| 2277 | CD44 | 3326668 | CTTTTCTACTGTACACCCCATCCCAG |
| 2278 | CD44 | 3326669 | ACAGTCCCTGGATCACCGACAGCACAGACAGAATCCCT |
| 2279 | CD44 | 3326670 | GTAAGGAGAATAAATCACTGTGCTTCCCAA |
| 2280 | CD44 | 3326671 | TTCCCTGGCAAAATGTCTCTGACCTTCCTGAGCATTGCACACTCACGTGCTGATTTTCTCGTCTCTAG |
| 2281 | CD44 | 3326672 | ACAGCTGGAAGCTGGTGATGCCATTCAGGGAG |
| 2282 | CD44 | 3326685 | GCGTCCAGCTCAGCCACTAATGCAAGTCACCACAACAG |
| 2283 | CD44 | 3326686 | CCTCAGTTTTTCTGGATCAGGCATTGATGATGATGAAGATTTTATCTCCAGCACCA |
| 2284 | CD44 | 3326696 | AATGGCACCACTGCTTATGAAGGAAACTGGAACCCAGAAGCACACCCTCCCCTCATTCACCATGAGCATCATGAGGA |
| 2285 | CD44 | 3326700 | CCAGGCAACTCCTAGTAGTACAACGGAAGAAACAGCTACCCAGAAGGAACAGTGGTTTGGCAACAGATGGCATGAGGGATATCGCCAAACACCCAAAGAAGACTCCCATTCGACAACAGGG |
| 2286 | CD44 | 3326701 | CACTGGAGGAATTGTCACGAGATGTTAGGTTACTTAATAAATTATGCTGCAGTTCACACAGAGCCAAACCTTAAAGGCTCATAACAAGTCACCTGAACAGGAATGGATACAAGCCAGTTATGAATAAGAACAGG |
| 2287 | CD44 | 3326703 | GGTAACTCATCCTTTCTGCACTGCGGGAGTTGTTAATGCTTTTGTGTCCTCCAGTTCACATGCTGATTGCTAAGAAGAAAATGAGCATGAGTGAACCCAAAGCTGCTGAAACATTCTGCGTTTATGCAACTTCCTTGCCCTCTATACAAGGAAGATGGTT |
| 2288 | CD44 | 3326704 | TCGGTGTATCCCTGACCAAGCGTCCATTAACACTTTGACAATTGCTCAAACTGCATGG |
| 2289 | CD44 | 3326705 | GCTCATACCAGCCATCCAATGCAAGGAAGGACAACACCAAGCCCAGAGGACAGTTCCTGGACTGATTTCTTCAACCCAATCTCACACCCCATGGGACGAGGTCATCA |
| 2290 | CD44 | 3326711 | GACTCCAGTCATAGTATAACGCTTCAGCCTACTGCAAATCCAAACACAGGTTTGGTGGAAGATTTG |
| 2291 | CD44 | 3326712 | CTTCTCTACATCACATGAAGGCTTGGAAGAAGATAAAGACCATCCAACAACTTCTACTCTGACATCAAGC |
| 2292 | CD44 | 3326714 | CTGAAGGCTCAACTACTTTACTGGAAGGTTATACCTCTCATTACCCACACACGAAGGAAAGCAGGACCTTCATCCCAGTGACCTCAGCTAAGACTGGGTCCTTTGGAGTTACTGCA |
| 2293 | CD44 | 3326716 | CCCATTCAAGGCTGTTTTGCCATCATTTTTTGGAATACCTTAAAAAGACTAAACTTTGTGATAGGCTGTATAAGAATGCAAAGGTAAAGAAATGCAGATGGGAGTGTAAGTGAAAACATGCAGTACTGACCTTCCTGATTGCTCATTACA |
| 2294 | CD44 | 3326717 | CCAGTGGGGGGTCCCATACCACTCATGGATCTG |
| 2295 | CD44 | 3326720 | AGCAAACACAACCTCTGGTCCTATAAGGACACCCCAAAT |
| 2296 | CD44 | 3326721 | AATGGCTGATCATCTTGGCATCCCTCTT |
| 2297 | CD44 | 3326723 | CGTCTTCTTGCTGTTAGGAGGTCTATGAAGCAGAGAAGAACTTTCCTTTGGAAAACAACTAAATGAAGACAGTCACCTCGCTAGAACTGACACATGGGCTGTTTTTATATTCTTGAAGGCCACTCTCTCCCTACCTGAACCAAGACCTATAGGTTTACATGTTATTTACATTTTATATATAATATATATATATATATACACATACATTATATATACACAATAGTAATTCTAGCAACAGAGGAAATGACCTTTAACAGGGGTATAAATCTAAATTTATAAAAGTATAAATCTAAATTTCTTACCCAAGCACTTTAAAGATACATTATTTTTCTCCAGGACGTAATTCATAGGAATATTAAGCCTTTTGTAAATGTCCCTTTAGATGGTTTCTCATAAGGTAAAAGAAACTTATTTCCAAGCAGGACCACCTTTATTGTGTCCCCAGATCACCTCACAGGGCAGAAAAATGCCCCTCAGTCTGGGAGAAGACCTAGAGAGAATTATGGACTCCTTACTGGTTTTTGGAAAGCAACCAACAGCTAATTCCAACACCATGGGCAGCCCATACAGTCTCTAATTATCTGAGAAAATCAAATGATGCTGTTACAATAATTACGCTGGTACAAGTTAATAAAAGTGCCATGTTACAGTCAAACAGCTATGTTGCTATCTATACCATTGAGGGCATAGTTTTAAAAGTAGTTATGCTACCTGATTGTATAAGGAACAAAACTGAGAGAAAAAATCTAAAAGGCCGCCTATGATTGAATGGAAAGA |
| 2298 | CD44 | 3326726 | CCAAGTGGACTCAACGGAGAGGCCAGCAAGTCTCAGGAAATGGTGCATTTGGTGAACAAGGAGTCGTCAGAAACTCCAGACCAGTTTATGACAGCTG |
| 2299 | CD44 | 3326727 | ACAAGGAACCTGCAGAATGTGGACATGAAGATTGGGGTGTAA |
| 2300 | CD44 | 3326728 | CCATTACAGGGAGCTGGGACACTTAACAGATGCAATGTGCTACTGATTGTTTCATTGCGAATCTTTTTTAGCATAAAATTTTCTACTCTTTTTGTTTTTTGTGTTTTGTTCTTTAAAGTCAGGTCCAAT |

TABLE 13-continued

Subtyping Target Sequences

| SEQ ID NO. | Gene | Affy Probeset ID | Sequence |
|---|---|---|---|
| | | | TTGTAAAAACAGCATTGCTTTCTGAAATTAGGGCCCAATTAATAATCAGCAAGAATTTGATCG<br>TTCCAGTTCCCACTTGGAGGCCTTTCATCCCTCGGGTGTGCTATGGATGGCTTCTAACAAAAAC<br>TACACATATGTATTCCTGATCGCCAACCTTTCCCCCACCAGCTAAGGACATTTCCCAGGGTTAA<br>TAGGGCCTGGTCCCTGGGAGGAAATTTGAATGGGTCCATTTTGCCCTTCCATAGCCTAATCCC<br>TGGGCATTGCTTTCCACTGAGGTTGGGGGTTGGGGTGTACTAGTTACACATCTTCAACAGACC<br>CCCTCTAGAAATTTTTCAGATGCTTCTGGGAGACACCCAAAGGGTGAAGCTATTTATCTG |
| 2301 | CD44 | 3326729 | TTTGCATGACCTGTTATCCCTGGGGCCCTATTTCATAGAGGCTGGCCCTATTAGTGATTTCCAA<br>AAACAATATGGAAGTGCCTTTTGATGTCTTACAATAAGAGAAGAAGCCAATGGAAATGAAAG<br>AGATTGGCAAAGGGAAGGATGATGCCATGTAGATCCTGTTTGACATTTTTATGGCTGTATTT<br>GTAAACTTAAACACACCAGTGTCTGTTCTTGATGCAGTTGCTATTTAGGATGAGTTAAGTGCCT<br>GGGGAGTCCCTCAAAAGGTTAAAGGGATTCCCATCATTGGAATCTTATCACCAGATAGGCAA<br>GTTTATGACCAAACAAGAGAGTACTGGCTTTATCCTCTAACCTCATATTTTCTCCCACTTGGCA<br>AGTCCTTTGTGGCATTTATTCATCAGTCAGGGTGTCCGATTGGTCCTAGAACTTCCAAAGGCT<br>GCTTGTCATAGAAGCCATTGCATCTATAAAGCAACGGCTCCTGTTAAATGGTATCTCCTTTCTG<br>AGGCTCCTACTAAAAGTCATTTGTTACCTAAACTTATGTGCTTAACAGGCAATGCTTCTCAGAC<br>CACAAAGCAGAAGAAGAAGAAAAGCTCCTGACTAAATCAGGGCTGGGCTTAGACAGAGTT<br>GATCTGTAGAATATCTTTAAAGGAGAGATGTCAACTTTCTGCACTATTCCCAGCCTCTGCTCCT<br>CCCTGTCTACCCTCTCCCCTCCCTCTCCCTCCACTTCACCCCACAATCTTGAAAAACTTCCTTT<br>CTCTTCTGTGAACATCATTGGCCAGATCCATTTTCAGTGGTCTGGATTTCTTTTTATTTTCTTTTC<br>AACTTGAAAGAAACTGGACATTAGGCCACTATGTGTTGTTACTGCCACTAGTGTTCAAGTGCC<br>TCTTGTTTTCCCAGAGATTTCCTGGGTCTGCCAGAGGCCCAGACAGGCTCACTCAAGCTCTTTA<br>ACTGAAAAGCAACAAGCACTCCAGGACAAGGTTCAAAATGGTTACAACAGCCTCTACCTGTC<br>GCCCCAGGGAGAAAGGGGTAGTGATACAAGTCTCATAGCCAGAGATGGTTTTCCACTCCTTC<br>TAGATATTCCCAAAAAGAGGCTGAGACAGGAGGTTATTTTCAATTTTATTTTGGAATTAAATA<br>CTTTTTTCCCTTTATTACTGTTGTAGTCCCTCACTTGGATATACCTCTGTTTTCACGATAGAAAT<br>AAGGGAGGTCTAGAGCTTCTATTCCTTGGCCATTGTCAACGGAGAGCTGGCCAAGTCTTCACA<br>AACCCTTGCAACATTGCCTGAAGTTTATGGAATAAGATGTATTCTCACTCCCTTGATCTCAAGG<br>GCGTAACTCTGGAAGCACA |
| 2302 | CD44 | 3326731 | AGACAAAGCCCCTTACACTCCTTAGTTCTTTATTCAGCATTGTTCTGCTCTCATTTATTAAAAAT<br>TCCAAGTACCATTGTCAGTATTCTTCAGAAAATCTTATAGTGCTGTCTCATTTCTCTTGGCAAAA<br>GAAAGCCTGTTGTGCAACCCAATGAATTT |
| 2303 | CD44 | 3326732 | TCTCTTCAATATAGTTACACAGGTGACTAAGTGTCACCCGCTTCCACCTTCTCTAATCAAGGAA<br>ATGGTGACGATCAGGTTACTATAGATTCCTTATAAGGTGCCTTCATAATGGATAACTGTA |
| 2304 | UPK2 | 3351695 | TGGGCTGCAATGCATTATGCTGATGGGTGTCCACACCAAGTTCAGCATCGATATGGTGACCTC<br>CTAGGAGTGGGAGACCGCCAGGTTGACTAAGGAAGGGTGAGCTGGCCCAGGTCAGAATGG<br>AACAGATTGAAACTCTGGTGCTGATCATGGTGGGATTGGGCACACAAGCCTGACAACACCAG<br>GACACCCTGTCTCT |
| 2305 | UPK2 | 3351698 | TCCAGCCTCAGGTCTCAAGGATAGAGGTGCCACCACTTCCCAAT |
| 2306 | UPK2 | 3351700 | AGCCTGCCAGCACCTATTCCACCTCCCAGC |
| 2307 | UPK2 | 3351701 | CCCTGCTGCCCATCCGGACCTTGCCCTTGATCCTGATTCTGC |
| 2308 | UPK2 | 3351702 | TTCAACATCTCAAGCCTCTCTGGTCTGCTGTCCCGGCGCTAACGGAGAGCTGCTGGTTGCC<br>TTGCCCCCCTGTCACCTCACAGGAGGCAATGCCACACTGATGGTCCGGAGAGCCAAT |
| 2309 | UPK2 | 3351703 | TGGTGACGTCCAGCTTTGTGGTGCCTCCGTGCCGTGGGCGCAGGGAACTGGTGAGTGTGGTG<br>GACAGTGGTGCTGGCTTCACAGTCACTCGGCTCAGTGCATACCAG |
| 2310 | UPK2 | 3351704 | GTGACAAACCTCGTGCCAGGAACCA |
| 2311 | UPK2 | 3351705 | CATTTCCTACCTAGTGAAGAAGGGGACAGCCACTGAGTCCAGCAGAGAGATCCCAATGTCCA<br>CACTCCC |
| 2312 | UPK2 | 3351706 | GCATGGTGGTCATCACGGTGCTGCTCTCTGTCGCCATGTTCCTGCTG |
| 2313 | UPK2 | 3351707 | GTGCTGGGCTTCATCATTGCCCTGGCACTGGGCTCCCGCAA |
| 2314 | UPK2 | 3351708 | AGTGCCTCACCTTCCAACACTCCATTATTCCTCTCACCCCACTCCTGTCAGAGTTGACTTTCCTC<br>CCATTTTACCACTTTAAACACCCCCATAACAATTCCCCCATCCTTCAGTGAACTAAGTCCCTATA<br>ATAAAGGCTGAGGCTGCATC |
| 2315 | TMEM45B | 3356039 | TGCAGACGGCTGCGAGGCGCTGGGC |
| 2316 | TMEM45B | 3356044 | GCAGGGCTGAGACTATCTTCTGCTCAGGAA |
| 2317 | TMEM45B | 3356053 | TCTCATGTTTTTCTATAAGCAGTTAAGAGAAGCCACACAGCATCCTGAACACTTTGCTTTCT |

TABLE 13-continued

Subtyping Target Sequences

| SEQ ID NO. | Gene | Affy Probeset ID | Sequence |
|---|---|---|---|
| 2318 | TMEM45B | 3356054 | ATGGCAAATTTCAAGGGCCACGCGCTTCCAGGGAGTTTCTTCCTGATCATTGGGCTGTGTTGG<br>TCAGTGAAGTACCCGCT |
| 2319 | TMEM45B | 3356055 | GTACTTTAGCCACACGCGGAAGAACAGCCCACTACATTACTATCAG |
| 2320 | TMEM45B | 3356056 | CGTCTCGAGATCGTCGAAGCCGCAATTAGGACTTTGTTTTCCGTCACTG |
| 2321 | TMEM45B | 3356057 | GTCATTTGGTCTAGGGAATCTCCTCATCATACCCAGAACCTTTAATTCATTTTCTGAGCCCTGT<br>GAAATAGATGTTCCCACTGGCAGAGATAATAGGGCAACAATTTCCTGATGGCCACTAGACTAT<br>TTTATCGTAACATCCATTGTGTACAGAGCTTTATAATACTAACGGTTGACAGCTCTCACATCATG |
| 2322 | TMEM45B | 3356058 | CACCATGTACCTATTCTTTGCAGTCTCAGGAATTGTTGACATGCTCACCTATCTGGTCAGCCAC<br>GTTCCCTTGG |
| 2323 | TMEM45B | 3356061 | AACCGGCCTCCGCTGGACCAGCACATCCACTCACTCCTGCTGTATGCTCTGTTCGGAGGGTGT<br>GTTAGTATCTCCCTAGAGGTGATCTTCCGGGACCACATTGTGCTGGAACTTTTCCGAACCAGT<br>CTCATC |
| 2324 | TMEM45B | 3356063 | ATTGGGTTTGTGCTGTTCCCACCTTTTGGAACACCCGAATGGGACCAGAAGGATGATGCCAAC<br>CTCATGTTCATCACCATGTGCTTCTGCTGGCACTACCTGGCTGCCCTCAGCATTGTGGCCGTCA<br>ACTATTCTCTTG |
| 2325 | TMEM45B | 3356065 | CCTTTTGACTCGGATGAAGAGACACGGAAGGGGAGAAATCATTGGAATTCAGAAGCTGAATT<br>CAGATGACACTTACCAGACCGCCCTCTTGAGTGGCTCAGA |
| 2326 | TMEM45B | 3356066 | TAAAGTCTGTGTTGGTATAGTACCCTTCATAAGGAAAAATGAAGTAATGCCTATAAGTAGCAG<br>GCCTTTGTGCCTCAGTGTCAAGAGAAATCAAGAGATGCTAAAAGCTTTACAATGGAAGTGGC<br>CTCATGGATGAATCCGGGGTATGAGCCCAGGAGAACGTGCTGCTTTTGGTAACTTATCCCTTT<br>TTCTCTTAAGAAAGCAGGTACTTTCTTATTAGAAATATGTTAGAATGTGTAAGCAAACGACAG<br>TGCCTTTAGAATTACAATTCTAACTTACATATTTTTTGAAAGTAAAATAATTCACAAGCTTTGGT<br>ATTTTAAAATTATTGTTAAACATATCATAACTAATCATACCAGGGTACTGCAATACCACTGTTT<br>ATAAGTGACAAAATTAGGCCAAAGGTGATTTTTTTTTAAATCAGGAAGCTGGTTACTGGCTCT<br>ACTGAGAGTTGGAGCCCTGATGTTCTGATTCTTCAAAGTCACCCTAAAAGAAGATCTGACAGG<br>AAAGCTGTATAATGAGATAGAAAAACGTCAGGTATGGAAGGCTTTCAGTTTTAATATGGCTG<br>AAAGCAAAGGATAACGAATTCAGAATTAGTAATGTAAAATCTTGATACCCTAATCTTGCTTCT<br>GGATCTGTTCTTTTTTTAAAAAAACTTCCTTCACCGCGCCTATAATCCTAGCACTTTGGGAGGC<br>CGAGGCAGGCAGATCACGGGGTCAGGAGATCAAGACCATCCTGGCTAACATGGTGAAACCC<br>CGTCTCTACTGAAAATACAAAAAATTAGCCGGGTGTGGTGGCGGGCGCCTGTAGTTCCAGCT<br>ACTCGGGAGGCTGAGGCAAGAGAATGGCATGAACCCGGTAGGGGAGCTTGCAGTGAGCCCA<br>GATCATGCCACTGTACTCCAGCCTAGGTGACAGAGCAAGACTCTGTCTCAAAAACAAGCAAAC<br>AGACTTCCTTCAACAAATATTTATTAAATATCCACTTTGCAACAGCACTGAAATGGCTGTAAGG<br>ACTCCTGAGATATGTGTCCAGCAAGG |
| 2327 | SCUBE2 | 3362192 | CGTGCCACTCAATACAAATGTTCTGCTATAGGGTTGGTGGGACAGAGCTGTCTTCCTTCTGCA<br>TGTCAGCACAGTCGGGTATTGCTGCCTCCCGTATCAGTGACTCATTAGAGTTCAATTTTTATAG<br>ATAATACAGATATTTTGGTAAATTGAACTTGGTTTTTCTTTCCCAGCATCGTGGATGTAGACTG<br>AGAATGGCTTTGAGTGGCATCAGCTTCTCACTGCTGTGGGCGGATGTCTTGGATAGATCACG<br>GGCTGGCTGAGCTGGACTTTGGTCAGCCTAGGTGAGACTCACCTGTCCTTCTGGGGTCTTA |
| 2328 | SCUBE2 | 3362193 | AGAAACTTATCAAGGCTCTGTTTGATGTCCTGGCCCATCCCCAGAACTATTTCAAGTACACAGC<br>CCAGGAGTCCCGAGAGATGTTTCCAAGATCGTTCATCCGATTGCTACGTTCCAAA |
| 2329 | SCUBE2 | 3362195 | GACTACCAGGAACTCATTGAAGACATAGTTCGAGATGGCAGGCTCTATGCATCTGAGAACCA<br>TCAGGAA |
| 2330 | SCUBE2 | 3362196 | TGGAAGCAACTAAATCATAAGAATGCAAAACATGTTCTTTATTCCAAC |
| 2331 | SCUBE2 | 3362200 | CACCCAAGACAAGGAGTTTTAGTATCTCTTGGGGTGGACCCAAATGCCTCCCACATGGCTCTG<br>CTGAGAGAGACAGAGAGCCTCATCTACCCAAAAGCAACCAACTGGCAACCTCTCCTATCTGGA<br>ATCAGG |
| 2332 | SCUBE2 | 3362201 | CAGCACATGGAAAGAGCGTCTCTGCTTTGAACAGAGCCAACTTCGGAGCCAGCTGGCAAACT<br>GCTGACAAGCACACATGCTCAGAAAGGCAGGCAAGATGAGGGGAAAAGACATTGCTGACTC<br>ACAAGTGCCAAATTTTA |
| 2333 | SCUBE2 | 3362202 | ATCGCCTTCACCTCCAGGTCAAAGAAGCTGTGGATTCAGTTCAAGTCCAATGAAGGGAACAG<br>CGCTAGAGGGTTCCAGGTCCCATACGTGACATATG |
| 2334 | SCUBE2 | 3362203 | TACTAGTTCTATGATCTCGGGCACACATTCTGAATCTTTCTGCACTTGTCTTCTCATCTGTTAAA<br>ATGGGGCTAGTAACAGTTGCTACCTTATAAGGTTATAAGGGCTAAAGGAGTTCATAGATGTG<br>AAACACTTAGAATAGGCCAGGCACAGTGGCTCACACCTGTAATCCCAGGCTGAGGGAGGAG<br>GCTGAACCAGGATTTTGTGACCAGGCTCGGTGAGACCCTGTCTCTATACATTTTTTTTTTTTA<br>ATTAGCTGGGCATGATGGTGCATGCCTGTGGTTCCGGCTACTCGGGAGGCTGAGATGGGTGA<br>ATCGCTTAAGCCTGGGAGGTGGAGGATGCAGTGAGCCGTGATCATGCCACTGCACTCCAGCC |

TABLE 13-continued

Subtyping Target Sequences

| SEQ ID NO. | Gene | Affy Probeset ID | Sequence |
|---|---|---|---|
| | | | TGGTAGACAGAGCCAGACCTTGTCTCAAAAAACAAACAAACAAACAAACAAACAAACA AGAATGATGATGACACATGGAGCCACTATATAAACGTTTGCTCTTCTTATTAGTGGTTAAAA TGTCTGAAGTCAAGTATAGGTTTAAATCCTTGTTTTACCACATACTGGCTATATGACCCTGGGC AAGTATTTAATCTCTCTATTAAAAAGGTAACGGTTGCACCAACTTTCTGTGGTTTTCAGAAGAT TAAATGAGACAAAGTCCATAAATTGCCTAGCATGCTGCCTGATCTTAGGCAGCAAATGGTGGT GATGACAATTAGATGACAGCAGGTCAGTTCTGGAATGGGAGGCCCTCACCCAGCTCCTACAG TGAACGGTACAGCCTGGGCTGCTGCTGCTTGCCAAGCCCCAGGTCTTTCAGGTGTAGCCTCCC CTGGGGGTCCACAATTACCAGCTGAATC |
| 2335 | SCUBE2 | 3362205 | GCTGGGAGATTTCACTGGGTACATTGAATCCCCAAACTACCCAGGCAATTACCCAGCCAACAC CGAGTGTACGTGGACCATCAACCCACCCCCCAAGCGCCGCATCCTGATCGTGGTCCCTGAGAT CTTCCTGCCCATAGAGGACGACTGTG |
| 2336 | SCUBE2 | 3362206 | TCACCGATGTATTCGTTGCCCAGTGGGAACATACCAGCCTGAATTTGGAAAAAATAATTGTGT TTCTTGCCCAGGAAATACTACGACTGACTTTGATGGCTCCACAAACATAACCCAGTGTA |
| 2337 | SCUBE2 | 3362207 | GTCAACCTGGTGAATATTCTGCAGATGGCTTTGCACCTTGCCATCTCTGTGCCCTGGGCACGTT CCAGCCTGAAGCTGGTCGAACTTCCTGCTTCCCCTGTGGAGGAGGCCTTGCCACCAAACATCA GGGAGCTACTT |
| 2338 | SCUBE2 | 3362208 | CTGGGACCTATTATGATGGAGCACGAGAACGCTGCATTTTATGTCCAAATGGAACCTTCCAAA ATGAGGAAGGACAAATGACTTGTGAACCATGCC |
| 2339 | SCUBE2 | 3362211 | CCTGAGCTGCATCGTAAAGCGAACCGAGAAGCGGCTCCGTAAAGCCATCCGCACGCTCAGAA AGGCCGTCCACAGGGAGCAGTTTCACCTCCAGCTCTCAGGCATGAACCTCGACGTGGCTAAAA |
| 2340 | SCUBE2 | 3362212 | GAGAGCTTCCGCTACGTAAACCTTACATGCAGCTCTGGCAAGCAAGTCCCAGGAGCCCCTGG CCGACCAAGCACCCCTAAGGAAATGTTTATCACTGTTGAGTTTGAGCTTGAAACTAACCAAAA GGAGGTGACA |
| 2341 | SCUBE2 | 3362213 | CCACCATCAGGACAAGTGTAACCTTTAAGCTAAATGAAGGCAAGTGTAGTTTGAAAAATGCT GAGCTGTTTCCCGAGGGTCTGCGACCAGCACTACCA |
| 2342 | SCUBE2 | 3362215 | CCTACTCTGTCACCTGTGGCTCTTCCT |
| 2343 | SCUBE2 | 3362216 | TGGTGGAGGAGACGGGTGCTTCCTCAGATG |
| 2344 | SCUBE2 | 3362217 | TGCCCACAAGTGTGTCACCCCGTGTGTCCCTGCACTGCG |
| 2345 | SCUBE2 | 3362218 | ACCAATGAGTGTCAGCATCAACAACGGAGGCTGTCAGCAGGTCTGTGTGAACACAGTGGGCA GCTATGAATGCCAGTGCCACCCTGGGTACAAGCTCCACTGGAATAAAA |
| 2346 | SCUBE2 | 3362221 | ACCACCCTGGCACATTTGCTTGTGCTTGCAACCGAGGGTACACCCTGTATGGCTTCACC |
| 2347 | SCUBE2 | 3362222 | ATGAGTGCCAGACCCGCAATGGAGGTTGTGATCATTTCTGCAAAAACATCGTGGGCAGTTTT GACTGCGGCTGCAAGAAAGGA |
| 2348 | SCUBE2 | 3362223 | AACGTGTGCTGTCAACAATGGAGGCTGTGACCGCACCTGTAAGGATACTTCGACAGGTGTCC ACTGCAGTTGTCCTGTTGGATTCACTCTCCAGTTGGATG |
| 2349 | SCUBE2 | 3362226 | GGTGACAGAGAGCAACACCACATCAGTGGTGGATGGGGATAAACGGGTGAA |
| 2350 | SCUBE2 | 3362234 | TGCATGAATAAGGATCACGGCTGTAGTCACATCTGCAAGGAGGCCCCAAGGGGCAGCGTCG CCTGTGAGTGCAGGCCTGGTTTT |
| 2351 | SCUBE2 | 3362235 | GGCTGCCAGCATACCTGTGTCAACGTCATGGGGAGCTATGAGTGCTGCTGCAAGGAGGGGTT TTTCCTGAGTGACAATCAGCACACCTGCATTCACCGCTCGGAA |
| 2352 | SCUBE2 | 3362240 | TGTGGAAATGAGCTCAATGGAGGCTGTGTCCATGACTGTTTGAATATTCCAGGCAATTATCGT TGCACTTGTTTTGATGGCTTCATGTTGGCTCATGACGGTCA |
| 2353 | SCUBE2 | 3362242 | TGTGCCCAAGGGCTAGATGACTGCCATGCCGACGCCCTGTGTCAGAACACACCCACCTCCTAC AAGTGCTCCTGCAAGCCTGGCTACCAAGGGGAAGGC |
| 2354 | SCUBE2 | 3362243 | CCGGGGCGGCCTGGGCGGTGCTGCTGCTGCTGCTGCTGCCGCCACTGCTGCTGCTGGCG GGGGCCGTCCCGCCGGGTCGGGGCCGTGCCGCGGGGCCGCAGG |
| 2355 | SCUBE2 | 3362244 | CGCCACCGCCCGCACTCCGCCGCCTCTGCCCGCAACCGCTGAGCCATCC |
| 2356 | SCUBE2 | 3362262 | GGCCCAGAGAGCTGCAGCGCAGCGTCCTGCCTGCAGAGGGGGTGAGAGGCCACACTGCAGC CGTCTGCCTGGAGCCCACGGACAGAGCTTTAGTTCTCTCGGAGAAGGCCGAGG |
| 2357 | AHNAK | 3375736 | CACCTGCAGTTAAAGGAATACCTTCCGCGAGGCGGCTTTTCGGAGCATGCATGTTTATAGCTC CAGCCAGGCCAGACCGAGGGCTGCTGCATAAGCCCTGCTTGGTGCATTTCTTTACTTGCAAGG |

TABLE 13-continued

Subtyping Target Sequences

| SEQ ID NO. | Gene | Affy Probeset ID | Sequence |
|---|---|---|---|
| | | | GGACAGAGTGTGGGCTTAGGTTTGGGACTAGAGGGGCTTTGGCAACTATGGTGCTCAGGT GATTATCCTTCGCTCGTTTA |
| 2358 | AHNAK | 3375738 | CAGCAGCCAAGCCGGGGCAGTTTCAGTCTCCACC |
| 2359 | AHNAK | 3375739 | CCAGCCAGTTTGGTGCTGACGGTGAGAGGAAATTAGAATCTGTTTGCAAATTGTCCAACCCAC CCCCTCAACATGAGGGGCTTCCATTTTCTGTGTTTTGTAAGGGAACTGTTTCCTTCATGCCGCC ATGTTCCTGATATTAGTTC |
| 2360 | AHNAK | 3375740 | GGGAAACACACCGACTGCCTCAGCAATCATGCAAAGACCTTGCCTGGCCCGGTGGCAAGCGC TGAAAAACCGACCGCCTGTAGGCTCCTGGAACTATACAGATAGGTAAAGAGTTCCAAGTTCG TCCAGCCCATGTGCAAAGTCAACAGTATTTGCCTTAAGATTTCATATATATATATTTTTTTGCAT TGACTGCTGAGAGCTCC |
| 2361 | AHNAK | 3375741 | GCTGAAATTCGGTACCTTTGGTGGATTGGGGTCAAAGAGCAAAGGTCATTATGAGGTGACTG GGAGCGATGATGAGACAGGCAAGTTACAGGGGAGTGGGGTGTCCCTGGCCTCTAAGAAGTC CCGACTGTCCTCCTCTTCTAGCAATGACAGTGGG |
| 2362 | AHNAK | 3375742 | CACGTCTGGATTTCGAAGGCCCTGATGCCAAACTCAGTGGCCCATCTTTGAAGATGCCATCGC TGGAGATATCTGCTCCTAAAGTAACTGCTCCTGATGTTGATTTGCATCTCAAGGCACCAAAAA TTGGATTTTCAGGTCCGAAGTTAGAAGGTGGTGAAGTGGACCTCAAGGGACCCAAAGTTGAA GCTCCAAGCTTAGATGTACACATGGACAGCCCAGATATTAACATCGAAGGGCCAGATGTTAA AATCCCCAAATTTAAGAAACCCAAGTTTGGATTTGGGGCAAAAAGCCCCAAAGCTGACATCAA GTCACCTTCACTGGATGTCACTGTTCCTGAGGCAGAGCTGAACCTTGAGACTCCTGAAATTAG TGTTGGTGGCAAGGGCAAGAAAGTAAGTTTAAAATGCCTAAAATTCATATGAGTGGTCCTA AGATTAAGGCCAAAAACAGGGATTTGACCTGAATGTTCCTGGGGGTGAAATTGATGCCAGC CTCAAGGCTCCGGATGTAGATGTCAACATCGCAGGGCCGGATGCTGCACTCAAAGTCGACGT GAAATCGCCCAAAACCAAGAAAACGATGTTTGGAAAAATGTACTTCCCAGATGTAGAGTTTG ACATTAAATCACCTAAATTTAAAGCTGAGGCCCCTCTCCCTAGCCCCAAACTGGAGGGTGAAC TCCAGGCACCTGATCTGGAACTTTCTTTGCCAGCGATTCACGTCGAAGGTCTTGACATCAAGG CGAAGGCTCCCAAGGTCAAGATGCCAGATGTGGACATCTCAGTGCCAAAAATAGAGGGTGAC CTGAAAGGCCCAAAGTGCAGGCAAACTTGGGTGCACCTGACATCAACATCGAAGGCCTAGA TGCTAAAGTCAAAACACCGTCCTTCGGCATTTCTGCCCCTCAAGTCTCCATCCCTGATGTGAAT GTAAACTTGAAAGGACCAAAGATAAAGGGTGATGTCCCCAGCGTGGGACTGGAAGGACCAG ATGTAGATCTGCAAGGTCCAGAAGCAAAAATTAAGTTCCCCAAGTTTTCCATGCCCAAGATCG GCATCCCAGGTGTGAAAATGGAGGGTGGGGGAGCCGAGGTCCATGCCCAGCTACCCTCTCTT GAAGGAGACTTGAGAGGACCAGATGTTAAGCTCGAAGGGCCCGATGTTTCTCTAAAGGGGC CAGGAGTAGACTTGCCTTCAGTGAACCTCTCTATGCCAAAAGTCTCTGGGCCTGACCTTGATC TGAACTTGAAAGGACCAAGTTTGAAGGGAGACCTGGATGCATCTGTTCCCAGCATGAAGGTG CATGCTCCAGGGCTCAACCTCAGTGGTGTCGGTGGCAAAATGCAGGTGGGAGGAGACGGTG TGAAAGTGCCAGGGATCGATGCCACAACAAAGCTTAACGTTGGGGCACCAGATGTGACACTG AGGGGACCAAGCCTGCAGGGAGATCTGGCTGTCTCTGGTGACATCAAATGCCCTAAAGTATC CGTAGGAGCTCCTGATCTAAGCTTGGAGGCATCCGAAGGCAGCATTAAACTTCCCAAAATGA AGCTGCCCCAATTTGGCATCTCTACTCCGGGGTCCGACTTGCACGTCAATGCCAAGGGGCCAC AGGTTTCTGGCGAACTGAAGGGGCCAGGTGTGGATGTGAACCTGAAAGGGCCTCGGATTTC AGCACCGAATGTGGACTTTAACTTGGAAGGACCAAAAGTGAAAGGGAGCCTTGGGGCCACT GGTGAGATCAAAGGCCCCACTGTCGGAGGAGGTCTTCCAGGCATTGGTGTTCAAGGCCTAGA AGGAAACCTCCAGATGCCTGGAATTAAGTCCTCTGGATGTGATGTGAACCTGCCAGGCGTGA ATGTGAAACTCCC |
| 2363 | AHNAK | 3375743 | GTCCAGACGCAAAACTGAAGGGCCCCAAGTTCAAGATGCCTGAAATAAATATC |
| 2364 | AHNAK | 3375744 | GCCCAAGGCCGACATCGATGTCTCGGGACCCAAG |
| 2365 | AHNAK | 3375745 | ATGTGGATGTTCATGGCCCAGACTGGCACCTGAAGATGCCCAAGGTGAAAATGCCCAAATTC AGCATGCCTGGCTT |
| 2366 | AHNAK | 3375746 | TGGATGTGAACCTGCCCAAGGCTGACATTGATGTCTCAGGACCCAAAGTGGACGTTGATGTT CCTGATGTGAATATCGAAGGTCCAGATGCGAAACTAAAGGGCCC |
| 2367 | AHNAK | 3375747 | TAAAAATGCCCAAAGTGAAAATGCCCA |
| 2368 | AHNAK | 3375748 | GTGGGCATTGACACTCCTGATATTGACATTCATGGTCCAGAAGGGAAACTGAAGGGCCCCAA ATTTAAAATGCCTGACTTACACCTCAAGGCACCGAAGATCTCTATGCCTGAAGTTGACCTGAA TCTGAAAGGTCCAAAGGTGAAGGGCGACATGGACAT |
| 2369 | AHNAK | 3375749 | AAAGGAGATATGGACATTTCCGTTCCTAAACTGGAGGGAGATC |
| 2370 | AHNAK | 3375750 | TAGACATTGAAGGTCCTGAAGGGAA |
| 2371 | AHNAK | 3375751 | AAGGGCCCTGAAATTGACATAAAAGGCCCCAGTTTGGACATTGACACACCTGATGTCAATATT GAAGGTCCGGAAGGGAAA |

TABLE 13-continued

Subtyping Target Sequences

| SEQ ID NO. | Gene | Affy Probeset ID | Sequence |
|---|---|---|---|
| 2372 | AHNAK | 3375752 | TTCCTAAGGCTGACATTGAGATTTCTGGCCCCAAAGTGGACATTGATGCCCCTGATGTCAGTA<br>TCGAAGGTCCAGATGCAAAACTCAAGGGTCCAAAGTTCAAGATGC |
| 2373 | AHNAK | 3375753 | ATGTGGACGTTCAAGGCCCAGACTGGCACTTAAAAATGCCCAAAGTGAAAATGCCCAAGTTC<br>AGCATGCCTGGCTTCAAAGGAGAGGGCCCAGATGTGGATGTGAACCTGCCCAAGGCTGACCT<br>TGACGTCTCAGGACCCA |
| 2374 | AHNAK | 3375754 | AGATGTGGATGTTTCTCTGCCTAAGATGGAAGGTGATCTAAAGGCCCCTGAAGTTGACATCA<br>AGGGCCCCAAAGTGGACATTGATGCCCCAGATGTGGATGTTCATGGCCCAGACTGGCACCTG<br>AAGATGCCCAAGGTGAAAATGCCCAAATTCAGCATGCCAGGATTTAAAGGAGAGGGCCCAG<br>AAGTGGATGTTAATTTGCCCAAAGCTGA |
| 2375 | AHNAK | 3375755 | GTGACATGCAAGTTCCTGACTTGGATATTAAAG |
| 2376 | AHNAK | 3375756 | GGCCCAGACTGGCACCTGAAGATGCCCAAGGTGAAAATGCCCAAGTTCAGCATGCCTGGCTT<br>CAAAGGAGAGGGCCCAGATGTGGATGTGAACCTGCCCAAGGCTGA |
| 2377 | AHNAK | 3375757 | GTGACCTCAAGGGTCCTGAAGTTGACATCAAGGGCCCCAAAGTGGACATTAATGCTCCAG |
| 2378 | AHNAK | 3375758 | AAGGGCGATGTGGATGTTTCTCTGCC |
| 2379 | AHNAK | 3375759 | AAATTTAAGATACCAGAGATGCACCTGAAGGCTCCCAAAATATCGATGCCTGACA |
| 2380 | AHNAK | 3375760 | CATTGACACTCCTGACATTAACATCGAAG |
| 2381 | AHNAK | 3375761 | CCAGAGGTTGATATCAAAGGCCCTAAAGTGGACATCAATGCCCCAGATGTGGATGTTCATGG<br>TCCAGACTGGCATCTGAAGATGCCCAAAGTGAAAATGCCCAAGTTCAGCATGCCTGGCTTCAA<br>AGGAGAAGGCCCTGAAGTCGATGTTACCCTCCCTAAAGCTGACATTGACATTTCTGGTCCCAA<br>TGTAGACGTTGATGTTC |
| 2382 | AHNAK | 3375762 | GTGATGTGGATATTTCTCTTCCCAAACTTGAAGGGGATCTGAAAG |
| 2383 | AHNAK | 3375763 | GCCCAAAGATAGATGTAGATGCTCCAGATATTGACATTCATGGCCCAGATGCCAAATTAAAAG<br>GTCCAAAACTGAAGATGCCTGACATGCATGTAAACATGCCCAAGATCTCCATGCCAGAAATTG<br>ACTTGAATTTGAAAGGCTCAAAGCTTAAGGGAGATGTTGATGTCTCTGGGCCCAAGTTGGAA<br>GGTGACATTAAAGCTCCCAGTTTGGATATAAAGGGCCCAGAGAGTGGACGTTTCCGGTCCTAA<br>GCTTAATATCGAAGGCAAGTCAAAGAAATCTCGTTTTAAGCTTCCCAAATTTAATTTTTCGGGC<br>TCTAAAGTTCAGACACCTGAAGTGGATGTCAAAGGTAAAAAGCCAGATATTGACATAACAGG<br>TCCAAAAGTTGATATTAATGCTCCTGATGTCGAGGTCCAAGGAAAAGTGAAAGGATCCAAGT<br>TTAAAATGCCTTTCCTGAGTATTTCATCTCCCAAAGTTTCTATGCCTGACGTGGAGCTAAATTT<br>GAAA |
| 2384 | AHNAK | 3375764 | CCAAGATCAGCATGCCTGGCTTCAAAGGAGAAGGTCCAGAAGTGGACGTGAACCTGCCCAAG<br>GCTGACCTTGACGTCTCAGGACCCAAGGTGGACGTTGATGTTC |
| 2385 | AHNAK | 3375765 | GCCCAAATTCAGCATGCCTGGCTTCAAAGGAGAGGGCCCAGATGTGGATGTGAACCTGCCCA<br>AGGCTGACCTTGATGTCTCAGGACCCAAGGTGGACATTGATGTTCCAGATGTGAATATCGAA<br>GGCCCAGAGGGAAAGTTGAAAGGTCCCAAATTCAAAATGCCTGAGATGAACATCAAAGCCCC<br>CAAGATCTCCATGCCTGACATTGATCTTAACCTGAAA |
| 2386 | AHNAK | 3375766 | TGGACATTGACGCACCTGATGTTGATGTTCATGGCCCAGACTGGCACCTAAAGATGCCCAAG<br>ATAAAAATGCCCAAGATCAGCATGCCTGGCTTCAAAGGAGAAGGTCCAGATGTGGACGTGAA<br>CCTGCCCAAGGCTGACATTGATGTCTCAGGACCGAAAGTGGATGTTGAATGTCCCGATGTGA<br>ATATCGAAGGACCTGAAGGAAAGTGGAAAAGTCCAAAGTTTAAGATGCCAGAGATGCATTTT<br>AAGACTCCAAAGATATCCATGCCAGATATTGACCTGAATCTCACAGGTCCAAAAATAAAGGA<br>GATGTGGATGTTACAGGCCCTAAGGTAGAGGGAGATCTGAAAGGTCCTGAAGTTGACCTCAA<br>AGGCCCCAAAGTGGACATTGATGTCCCAGATGTTAATGTTCAGGGTCCAGACTGGCACCTGA<br>AGATGCCCAAGATGAAAATGCCCAAGTTCAGCATGCCTGGCTTCAAAGCAGAGGGCCCTGAA<br>GTGGATGTGAACCTGCCCAAGGCTGACGTTGATGTCTCAGGCCCCAAAGTGGACGTTGAAGG<br>CCCTGATGTTA |
| 2387 | AHNAK | 3375767 | GTGGAAGGTGACCTCAAGGGCCCAG |
| 2388 | AHNAK | 3375768 | AAAGGACCCAAAGTGAAGGGTGATG |
| 2389 | AHNAK | 3375769 | AGAGGGCCCTGAAGTAGACGTCAACTTGCCTAAGGCTGACGTTGACATCTCAGGACCCAAGG<br>TGGACATTGAAGGCCCTGATGTTAATATTGAAGGACCAGAGGGA |
| 2390 | AHNAK | 3375770 | AAGTACCAGATATGAACATCAGGGGCCCCAAAGTTGATGTAAATGCCCCCGATGTCCAAGCT<br>CCAGACTGGCACCTGA |
| 2391 | AHNAK | 3375771 | ACTCCTAAGTTCAAGATGCCAGATATGCACTTTAAAGCTCCCAAAATCTCTATGCCAGACCTCG<br>ATCTACACTTGAAGAGCCCCAAGGCAAAAGGAGAGGTGGATGTAGATGTTCCCAAATTGGAA<br>GGGGACCTTAAAGGGCCACATGTGGATGTC |

TABLE 13-continued

Subtyping Target Sequences

| SEQ ID NO. | Gene | Affy Probeset ID | Sequence |
|---|---|---|---|
| 2392 | AHNAK | 3375772 | CAGAATTGGATGTCAAAGGTCCCAAATTAGATGCTGACATGCCAG |
| 2393 | AHNAK | 3375773 | CTCCATGCCTGATGTTGATTTCAATTTAAAGGGACCCAAAATCAAAGGAGATGTTGATGTTTC<br>TGCCCCAAAG |
| 2394 | AHNAK | 3375774 | GTTCCCAAGGTAGAAGGTGAAATGAA |
| 2395 | AHNAK | 3375775 | TGAGATGCACTTCAAGGCCCCCAAGATCTCCATGCCTGATGTGGACTTACACTTGAAAGGCCC<br>CAAAGTCAAAGGGGATGTGGATGTGTCTTTGCCAAAATTGGAGGGAGATTTAACAGGCCCCA<br>GTGTGGATGTGGAGGTGCCTGATGTTGAGCTGGAGTGTCCT |
| 2396 | AHNAK | 3375776 | GCCCAAGTTCAGCATGCCTGGCTTCAAA |
| 2397 | AHNAK | 3375777 | CATTGATGCCCCAGATGTGGATGTTCATGGCC |
| 2398 | AHNAK | 3375778 | CCGCAAGTTGATGTCAAAGGTCCTTTTGTGGAAGCGGAGGTGCCCGATGTTGATCTGGAGTG<br>TCCTGATGCAAAGTTGAAAGGGCCCAAGTTTAAGATGCCTGAGATGCACTTCAAGGCCCCCA<br>AGATCTCCATGCCTGATGTGGACTTACACCTGAAAGGCCCCAAAGTCAAAGGGGATGTCGGAT<br>GTGTCGGTGCCAAAATTGGAGGGAGATTTAACAGGCCCCAGTGTGGGTGTGGAGGTGCCTG<br>ATGTTGAGCTGGAGTGTCCTGATGCAAAGTTGAAAGGCCCTAAATTTAAGATGCCAGACATG<br>CACTTC |
| 2399 | AHNAK | 3375779 | ATGTGGAGGTTCACGACCCAGATTGGCACCTGAAAATGCCCAAGATGAAAATGCCCAAGTTC<br>AGTATGCCTGGCTTCAAAGCAGAGGGCCCTGAAGTGGATGTGAATCTGCCAAAGGCTGACAT<br>TGATGTGTCTGGACCCAGTGTGGACACTGATGCTCCTGATTTGGATATTGAGGGACCAGAAG<br>GAAAGTTGAAAGGCTCCAAATTTAAGATGCCCAAGTTGAATATAAAAGCTCCCAAGGTCTCCA<br>TGCCAGATGTGGACTTGAATTTGAAGGGACCCAAACTGAAGGGAGAGATAGATGCTTCTGTG<br>CCA |
| 2400 | AHNAK | 3375780 | GCCTGATGTGGACCTGAATCTTAAGGGGCCAAAATTGAAGGGAGATGTGGATGTGTCCTTGC<br>CTGAGGTAGAAGGTGAAATGAAAGTGCCAGATGTTGACATTAAAGGGCCCAAAGTTGACATT<br>AGTGCTCCAGATGTGGATGTTCATGGCCCAGATTGGCACCTGAAGATGCCCAAGGTGAAAAT<br>GCCCAAGTTCAGCATGCCCGGCTTCAAAGGAGAGGGCCCTGAAGTGGATGTGAAGCTGCCCA<br>AGCTGACGTTGATGTCTCAGGACCCAAAATGGATGCTGAAGTTCCAGATGTGAATATTGAA<br>GGTCCAGACGCAAAACTAAAAGGTCCCAAATTCAAGATGCCAGAAATGAGTATAAAAGCCTCA<br>GAAGATATCCATACCAGATGTTGGTTTGCATTTGAAAGGTCCTAAAATGAAAGGAGATTATG<br>ATGTAACAGTTCCAAAAGTAGAAGGAGAGATAAAAGCTCCTGATGTTGACATCAAAGGCCCC<br>AAAGTTGATATTAATGCACCAGATGTGGAGGTTCATGGCCCAGACTGGCACCTGAAGATGCC<br>CAAGGTAAAAATGCCCAAGTTCAGCATGCCTGGCTTTAAAGGAGAGGGCCCAGAGGTGGAT<br>ATGAACCTGCCCAAGGCTGACCTTGGTGTTTCAGGACCCAAGGTGGACATTGATGTTCCAGAT<br>GTGAATCTTGAAGCTCCAGAGGGGAAACTAAAAGGCCCTAAGTTCAAGATGCCAAGCATGAA<br>TATACAGACGCACAAAATCTCTATGCCTGATGTTGGACTTAATTTGAAAGCCCCTAAACTGAA<br>AACTGATGTAGATGTTTCCCTTCCCAA |
| 2401 | AHNAK | 3375781 | GACCCAGAGCCGTACCATCACAGTGACCAGAAGGGTCACGGCCTACACTGTGGATGTGACTG<br>GCCGGGAAGGAGCCAAGGACATAGACATCAGTAGCCCTGAATTCAAGATCAAGATTCCAAGA<br>CATGAACTGACTGAAATCTCCAATGTGGATGTGGAGACCCAGTCTGGGAAGACCGTGATCAG<br>ACTGCCCTCGGGCTCGGGGGCAGCCTCTCCGACAGGCTCTGCTGTGGATATCCGAGCAGGGG<br>CCATTTCTGCTTCAGGACCAGAGCTCCAAGGTGCTGGCCACTCGAAGCTCCAGGTCACCATGC<br>CTGGGATAAAGGTGGGAGGCTCAGGTGTCAATGTCAATGCAAAGGGCTTGGACTTGGGTGG<br>CAGAGGAGGGGTCCAAGTTCCAGCAGTGGACATTTCATCTTCTCTTGGGGGTAGGGCAGTAG<br>AGGTACAGGGCCCATCTCTGGAGAGTGGTGATCATGGCAAAATTTAAATTTCCCACCATGAAA<br>GTGCCGAAATTTGGTGTCTCAACAGGGCGTGAGGGCCAGACACCAAAGGCAGGGCTGAGGG<br>TTTCTGCACCTGAAGTCTCTGTGGGGCACAAGGGCGGCAAGCCAGGCTTGACTATCCAAGCC<br>CCTCAGCTGGAAGTCAGTGTGCCCTCTGCCAATATTGAGGGCCTTGAGGGGAAGCTGAAGGG<br>CCCCCAAATCACTGGGCCATCACTTGAGGGTGACCTAGGCCTGAAAGGTGCCAAGCCACAGG<br>GGCACATTGGGGTGGATGCCTCTGCTCCCCAAATTGGGGGTAGCATCACTGGCCCCAGTGTG<br>GAAGTTCAGGCCCCTGACATTGATGTTCAGGGGCCTGGGAGCAAACTGAATGTGCCCAAGAT<br>GAAAGTCCCCAAGTTCTCTGTATCAGGTGCAAAGGGAGAGGAAACTGGGATTGATGTGACAC<br>TGCCTACAGGTGAAGTGACTGTTCCTGGGGTCTCTGGGGATGTCAGCCTGCCTGAGATTGCTA<br>CTGGTGGGCTGGAAGGAAAGATGAAAGGTACTAAAGTGAAGACTCCTGAAATGATTATTCAG<br>AAACCTAAAATCTCCATGCAGGATGTGGATCTGAGCCTTGGGTCTCCTAAACTGAAAGGAGA<br>TATTAAGGTTTCTGCTCCTGGGGTGCAAGGTGATGTTAAAGGCCCTCAAGTGGCACTTAAAG<br>GCTCCAGAGTGGACATAGAGACACCAAACCTAGAGGGAACCTTGACAGGCCCTAGGCTTGGC<br>AGTCCTTCCGGGAAAACCGGAACCTGTAGGATCTCTATGTCAGAAGTAGACTTAAATGTGGC<br>CGCACCTAAAGTGAAAGGGGTGTAGATGTCACACTCCCCAGAGTAGAAGGGAAAGTCAAA<br>GTCCCTGAAGTTGATGTCAGAGGCCCCAAAGTGGATGTCAGTGCCCCAGATGTCGAAGCGCA<br>TGGCCCCAGAATGGAACCTGAAAATGCCCAAGATGAAAATGCCCACGTTCAGCACTCCAGGAG<br>CCAAAGGGGAAGGTCCAGATGTTCATATGACTCTACCCAAAGGAGATATCAGTATTTCAGGG<br>CCCAAGGTCAATGTGGAAGCCCAGATGTCAACTTGAGGGTCTGGGGGAAAACTTAAAG<br>GCCCCGATGTTAAGCTGCCTGATATGAGTGTCAAGACACCAAAGATCTCCATGCCTGATGTAG<br>ATTTGCACGTGAAAGGTACAAAGGTGAAGGAGAGTATGATGTAACTGTACCAAAGCTGGA<br>AGGAGAACTCAAAGGCCCAAAAGTGGACATTGATGCCCCAGATGTGGATGTTCATGGCCCAG |

TABLE 13-continued

Subtyping Target Sequences

| SEQ ID NO. | Gene | Affy Probeset ID | Sequence |
|---|---|---|---|
| | | | ACTGGCACTTGAAGATGCCCAAGATGAAAATGCCCAAATTCAGTGTGCCAGGGTTCAAAGCA GAGGGCCCAGAAGTGGATGTGAACCTGCCCAAGGCTGATGTGGACATTTCCGGGCCCAAGA TAGATGTTACTGCTCCTGATGTGAGCATTGAGGAACCAGAAGGGAAATTGAAAGGGCCCAAG TTTAAGATGCCTGAGATGAACATCAAAGTCCCCAAGATCTCCATGCCTGATGTGGACTTACAT CTGAAAGGCCCTAACGTAAAGGGAGAATATGATGTCACAATGCCAAAGGTTGAAAGTGAGAT TAAAGTTCCTGATGTTGAACTTAAAAGTGCCAAAATGGACATTGATGTCCCAGATGTGGAGGT TCAAGGCCCAGACTGGCACCTGAAGATGCCCAAGATGAAAATGCCCAAGTTCAGCATGCCTG GCTTCAAAGCAGAGGGCCCAGAAGTGGATGTGAACCTGCCCAAGGCTGATGTGGACATCTCA GGACCCAAGGTGGGTGTTGAAGTTCCAGATGTGAATATTGAAGGACCTGAAGGAAAGCTGA AGGGCCCCAAGTTCAAGATGCCAGAGATGAATATCAAGGCCCCCAAGATCTCCATGCCTGAT GTGGACTTGCATATGAAAGGTCCTAAAGTAAAGGGAGAATATGATATGCAGTGCCAAAGCT GGAAGGGGACCTGAAAGGCCCAAAAGTAGATGTCAGTGCCCCAGATGTTGAAATGCAGGGT CCTGACTGGAACTTGAAGATGCCAAAGATTAAAATGCCCAAATTTAGCATGCCCAGCCTCAAA GGAGAGGGGCCAGAATTTGATGTGAACCTGTCCAAAGCGAATGTG |
| 2402 | AHNAK | 3375783 | GGGTGCCACCATCTACTTTGACAACCTGCAGTCGGGTGAGGTGACCCAGCTGCTGAACACCA TGGGGCACCACACGGTGGGCCTGAAGCTGCACCGCAAGGGGGACCGCTCTCCCGAGCCTGG CCAGACCTGGACCCGTGAAGTCTT |
| 2403 | AHNAK | 3375784 | AAGGAGGAGACAACCCGGGAGCTGCTGCTGCCCAACTGGCAGGGTAGTGGCTCCCACGGGC TGACCATCGCCCAGAGGGACGACGGCGTCTTTGTGCAGGAGGTGACGCAG |
| 2404 | SYTL2 | 3385044 | CCAGAGCATTAAACATGGGGTATTGTTAAGAAGCAAAATGTTCTTGTTTGCCATCATGTGTTT CACACCACAATTCTGTGCCACAGTTAAGAGGGTCTGGTACCCTTGCAGGACCTTTGTAGGTTG TGGGAAAAAGTCGCAGAAAGATACTCAAAGTGGAGCAGGGAATGGAGACAGACATCAGTGA TGATAAAAAAAAAAATGGACCTTAAGAAACTATTTACTCTGTAATCTCTAATAAAATATGGAA TTCCATATTAGGGCAATGAGACTGAAACTACTGGTGTTTTCTGCCTTGAGAAAACAAACAGT TAAAACAAGCCTCAAATGTATTTTAGTGCCACCCACTGGCCATAGGTACAATTCAGTTGTTGG CTTGTTTTGACTTAATTCTAAAATAGGTCTCAAGCCTGTATTTTTATGA |
| 2405 | SYTL2 | 3385045 | CTACTAAACCGGTGGAATCTGATCTTGAAAATCTGAGTAGGTGGACAAATATCCTCACTTTCT ATCTATTGCACCTAAGGAATACTACACAGCATGTAAAAGTCAATCTGCATGTGCTTCTTTGATT ACA |
| 2406 | SYTL2 | 3385046 | TGGACTCTACTTCAGAGGAAGTTGCTCTCTGGGAGAAGATGGTAAACTCCCCCAATACTTGGA TTGAAGCAACACTGCCTCTCAGAATGCTTTTGATTGCCAAGATTTCCA |
| 2407 | SYTL2 | 3385048 | CTATGGTGTATGATGGGTTCAGGCCTGAAGATCTGATGGAAGCCTGTGTAGAGCTTACTGTCT GGGACCATTACAAATTAACCAACCAATTTTTGGGAGGTCTTCGTATTGGCTTTGGAACA |
| 2408 | SYTL2 | 3385052 | AAGCTTCCTACAACTGGAGAAGTGCACATCTGGGTGAAGGAATGCCTTGATCTACCACTGCTA AGGGGAAGTCATCTAAATTC |
| 2409 | SYTL2 | 3385055 | AATGAAACTAGCTCTCCAGTATGTCCCA |
| 2410 | SYTL2 | 3385060 | CACAGAAATTGAACCTGTCCATTTGGCATCGGGATACATTTAAGCGCAATAGTTTCCTAGGGG AGGTGGAACTTGATTTGGAAACATGGGACTGGGATAACAAACAGAATAAACAATTGAGATG GTACCCTCTGAAGCGGAA |
| 2411 | SYTL2 | 3385064 | TTGCCCAGGCTGGCACGATCTCAGC |
| 2412 | SYTL2 | 3385065 | GTGATGAGTGTTTATAGTGGAGACTTTGGCAATCTGGAAGTTAAAGGAAATATTCAGTTTGCA ATTGAATATGTGGAGTCACTGAAGGAGTTGCATGTTTTTGTGGCCCAGTGTAAGGACTTAGCA GCAGCGGATGTAAAAAAACAGCGTTCAGA |
| 2413 | SYTL2 | 3385067 | GAGCTCTTTAACCAATCTTAGCAGCTCCTCTGGCATGACGTCCTTGTCTTCT |
| 2414 | SYTL2 | 3385071 | ATGAGCAAGTCTGTTCCAGCATTTCTCCAA |
| 2415 | SYTL2 | 3385072 | TGCCTACACAACCTGATAATCCATTTTCTCACCCTGACAAACTC |
| 2416 | SYTL2 | 3385073 | ACCATTCTAACTTTGCCTTGGGATATTGAAAATTCTGAATCAGTGAGGTATCTAAATAATTTAT ATTTTCAAAAAATAATGTTTATTTTATAATTCTGAGTGTAAAACACTATCAGAAAAGTAATCCT CATGCTCACTAAACAAACCTACTCTAAGACACTCAACAACCAGAACAGTTTTATTATTGAGTTG TGTACAAAAATCTTGACTGTCCAGATGAAATAGTTTTTCAGCCTGCAGTGTGTTAGTGATATAT CTCAAGGAGATGAACCAATAAAGTACAGACTTTGTGGTCTGAAGCTCTGTTGTGAAAAAATA AGCTAAACCAATTCACACTGACAGTATAATTTGATTCAAGTGCAGCTCCAGTTCAATAAAAACT AATGTTTTTAAAATTAACTTTGTTTTGTATTTGGTTCAACTCCTTGCTAGTTCTCTCTATATAA TTTATAAAAACTGCATGTTGCTAATCTCATGATCCTGTGCATGTGGACTACTCTGCCTTTAACTTT |
| 2417 | SYTL2 | 3385076 | AGTTACAAATGAATGCGTACCAAGAA |
| 2418 | SYTL2 | 3385077 | CCTGTCAGATGTATTCTGCTGTCTCAGTTGTGAAACTGACATTTGAGCTTTACTTTCATGTCTCT TTAATCCTTCTGTTAAAATGGTATTTATTCTCAATGTTGCCCTCCTGAGTA |

TABLE 13-continued

Subtyping Target Sequences

| SEQ ID NO. | Gene | Affy Probeset ID | Sequence |
|---|---|---|---|
| 2419 | SYTL2 | 3385080 | AAGTAGATAATCAGCCAGAAGAATTAGTGCGTAGTGCTGAA |
| 2420 | SYTL2 | 3385081 | GGTTGCACCCCTCATTGCATCTTGACTAATTGCTTCCAACTCCGGGGGCTTCCAGGGACAATCTCATTGTTCTTTTCTCTCCAAGGGTCAGCCATG |
| 2421 | SYTL2 | 3385083 | TGCCAAGATTCCACTTAGCAGCTGGTCCCCAGTTACATCTCTTCAGTTGACTTCCCAAGCAAGCCTCCCAGAGGCATATGTGAATGATGATGC |
| 2422 | SYTL2 | 3385086 | AAACTTTGGAAAGGAGTGCCGCTAGGAAAATGCCTTCCAAAAGTCTAGAAGACATTTCATCAGATTCATCAA |
| 2423 | SYTL2 | 3385092 | ATGGAAACACCAGTTCTAATGCAGAGAGCTGGAG |
| 2424 | SYTL2 | 3385093 | GTAAAGTTGAATTGACTCTAGCATCGCCATATATGAAACAAGAGAAAGAGGAAGAAAAAGAAGGTTTCTCTGAGTCTGATT |
| 2425 | SYTL2 | 3385094 | CTGAAGCAATTAGTGTGTCCAGAAATAGGCAACCCATTCCTCTCC |
| 2426 | SYTL2 | 3385095 | AGATTTTTGTGGTTCCAGAAGTGGAGTTGAGATCCCTAGAACCCCACAACTTTATGTGGCTCATGAAATAGGGACCATTAAAACTGTAACCCCCCAGAGGACAGGGACAGTGAAAGTGGGGTTGC |
| 2427 | SYTL2 | 3385096 | GTAATGGTTTGGAATCTCAAGTCAACCAATGTGATAAAATGTTGGGAGGAGACGCACTTGTGACTGATTTAT |
| 2428 | SYTL2 | 3385097 | CTCACAGACCTCTGAAATGAAGGATAAAA |
| 2429 | SYTL2 | 3385098 | ATAGGTAGTACAGAGGAGCCCAGGCGAGCCACTTCTGAATGCCATCCTGAGGAATTAAAAGAAACAGTAGAAAAGGCCGAGGCTCCGTTAATAACTGAGAGTGCTTTTGATGCTGGTTTTGAGAAACTTCTTAAAGAAATAACTGAAGCTCCTCCTTATCAGCCCCAGGTGTCAGTGAGAGAAGAAACTCACGAGAAGGAGTCCTCACAGTCAGAGCA |
| 2430 | SYTL2 | 3385099 | GTGAGGGAAACAATTGTTCAACCCAAATCAGAG |
| 2431 | SYTL2 | 3385100 | TGGGCTACGATGGACACCATAGTTCCAGACAGGAAGGATTTTTATTCCTCCAATGTAGTTCCTGATAAAACTCATGAAGTTGGATCTTATTTAGCTGCCCAAATGTCTCCATCAGACCAGACGCTTAGCTCATTTGCTTCCATTGTTGCTCAATATGGCAAAGGCC |
| 2432 | SYTL2 | 3385101 | AAGTATGGTTAAGTTATCCAGCTGGAAGGGAAGTAGGTCCTGGAGAAGTGAACCCAGAATTTCCTGAAGCAGTACAGCCAGTATGTAGCCCCCTAAATCC |
| 2433 | SYTL2 | 3385102 | TCCATTGGATCCAACTTCCCAGCTTTCCAGAAAGGGTTCTTTTGGGGATGTGGCCAGCCCTCCCCAAGATATGCTTTTTCCCCAGGATGCTCATCTTGTTCCCCAGGCTAGGGTACACCCTTCTCAAACGGAAATTTCGGAGACTGTAGAGAAAGTCATTCTTCCACCCAGACCTGTATTGAATGA |
| 2434 | SYTL2 | 3385103 | TTCAAAGGGCATACTCCAGGTGCTACCAGATGAAATCACATTTCCTTTGAGTCCACTTAGAAAGTATACTTATCAGTTGCCAGGAAATGAGTCATCAAAGGAAAATGTGGAAAAGAATACGGAAGGGATTGTTACTCCAGTGTTTAAGGAAGAAAAGGATTACTCAGAACAAGAGATTCAAGAATCCATAATAAAAACCAATGTTTTGTCTAAAGACTGCAAAGACACTTTTAATGACAGCTTGCAGAAACTGCTTTCAGAAACCTCAACACCAGCAATTCAACCCTCTGGTGGAAAAGTTCATGGAAAACAAGTGCTTGAACCAAGTGTTTCTGAAAATAGGACATGGCCTCAAAAAACAGATTTTGCTGATACTGAGGAAGAAGTCAAAGGACCTGAGAAGATCATTAATGAGCATGTTGACAAAACAGTAGTTCATCCAAAGGTTAAACGGAACTCTTTGACTGCTAGTCTAGACAAACTCCTGAAGGAAGCAACTGGAACTTCACCCTCTCCCTTGCAAGCCAAGTTGGCGCCTGTTATCACTGGAACCAACTCTAAGCTGGAAGAGGGGAGATTTTTTGGAAAAGGGATAGAACAGAGTCACAATACTTCAGCTGATAAGAGAGAAATACTAGCTCCTTTTCCAGTGAGAGA |
| 2435 | SYTL2 | 3385104 | TTCTGCTAAAGCATATCAGCCTGTGAAGAAGTCACAGGGTGTATCATCCATGGACAGTTTATCTACAGACCAGAGTGAATATAATCAGGCCATTCCCAAACGAGTGGTCTTAGATGAGGATGATCAAGCATCCCAGCTCTCCAATTCTTATTCCTCAAATAAATCTAAAGAGACCAAGCCACAAATAGCAGGTCCATCCAGATACTATCTTTCAGCTGAGCAATCAGATAAAGTGTCTCTGTTTCAGAATAAGAAAAATGAGCCTATAAAAGATCACAAGTGGCAGACAGTTTGCCTTCTAGAAGAACATTACTTTACCAGCACTGCAACCTCCCTCAAATGTCGGGAGTGAACGACATGCTCCATTGGAGAAAGACAGACCTCTAGTTCGTGAATCA |
| 2436 | SYTL2 | 3385105 | AACCAAGTGCAGAGAGAGAAATACAAAAGAGTGAGTGACAGAATATCCTTTTGGGAAGGA |
| 2437 | SYTL2 | 3385106 | CACGTTCTGGTCCATATGCCACTGAGATAAAGAAGTCAACTGATGATTCCATATTTAAAGTTCTAGACTGGTTTAACCGAAGTTCTTATTCAGATGACAATAAGTCATTCCTCCAACATCCCCGAGGAATAGAGTCCAAGAAAAAACAGACTCAAAATCACAGGTTGCTGTTGACTTGGTGACAGATGACACTACTTTAAGAGAAAATGGCTCAAAGACCCTATCACCCAGCAAAATTGAATTGAAGCCTGTGAGATCTGACTCACCATTCCAAGCAGAGGGAGATATGCTGGTTTCTGAAAGTTGCCAAGATAATAATGTGAATATCAAATCCAAATTCATGAATTTGTCCCAAAAAGGCACCCCAAAGGAAGGC |

TABLE 13-continued

Subtyping Target Sequences

| SEQ ID NO. | Gene | Affy Probeset ID | Sequence |
|---|---|---|---|
| | | | CCAGGTATATTGCAACCATTTGAAAGCTATGGCACCCCAAGTCAAGGGAGTAAAAATATGGA CTATAGCCAAGATTCAAAAAGCCCAGGAAAAGGGAATGGGGCATCTCCTTCAAATAGTAACT |
| 2438 | SYTL2 | 3385107 | TAAGCCCCCTCCTCTCCCGGCTCTA |
| 2439 | SYTL2 | 3385108 | ATGAACTGTCTCATTGTGTTGAGCCTGAGCCATCTCAGGTGCCAGGTGGCAGTTCTAGAGACC GTCAGCAAG |
| 2440 | SYTL2 | 3385110 | GTTGTCACTACTAGATTATAAAAAC |
| 2441 | SYTL2 | 3385111 | GTGACCCTAAGCCTTCTCAATACAGAAAGCCTTCGCTTTTTCATCAATCAACCTCAAGCCCATA TGTATCAAAAAGTGAAACACATCAGCCAATGACTTCTGGTTCTTTTCCAATTAATGGGCTGCAT TCTCATTCAGAAGTTTTAACTGCAAGACCACAGTCTATGGAGAATTCACCAACCATCAATGA |
| 2442 | SYTL2 | 3385112 | GAATTTAGTGTTTTAGAATCTGACAGAT |
| 2443 | SYTL2 | 3385113 | AGAGGGATCCTCAAGCGCAACTCCAGTTCCAGTAGCACAGACTCAGAAACCCTTCGTTATAAT CACAACTTTGAACCCAAAAGCAAAATTGTGTCACCTGGCCTAACCATCCATGAGAGAATTTCT GAGAAGGAGCATTCTTTAGAAGACAACTCTTCCCCAAACTCCCTGGAGCCATTAAAGCATGTG AGATTCTCTGCAGTGAAGGATGAGCTTCCACAGAGTCCTGGGCTAATCCATGGTCGGGAA |
| 2444 | SYTL2 | 3385114 | GAAAAGTCAACTGTCGCAGATACTTCAATCCAAAAGTTAGAGAAATCAAAGCAGACTTTGCCA GGCCTTTCAAATGGGTCCCAAATCAAGGCTCCAATCC |
| 2445 | SYTL2 | 3385116 | AGGAAGAATCCGTTTAATAGCTCCAAGTTGCCAGAAGGTCACTCATCACAACAAACTAAAA |
| 2446 | SYTL2 | 3385117 | CAGTGTGGTAAATCCAGCTTCCAGTGTGATTGATATGTCCCAGGAAAACACAAGGAAACCAA ATGTGTCT |
| 2447 | SYTL2 | 3385119 | TCCAGAGCTGGCTGGCGTTGTAGAAGAGCCAGAAGAAGATGCAGCACCAGCAAGCCCGAG |
| 2448 | SYTL2 | 3385120 | GAAAAAATTAAGGATGACCAGCAGCTGAAGAATATGAGTGGCCAATGGTTTTATGAAGCCAA GGCAAAAAGGCACAGGGACAAAATCCATGGCGCAGATATCATCAGAGCATCTATGAGAAA |
| 2449 | SYTL2 | 3385121 | ATGAAGGTTTTGCAGCGGGATGCTGCTCTGAAGAGGGCCGAAGAAGAGAG |
| 2450 | SYTL2 | 3385122 | ATGATTGACTTAAGCTTCCTGACTGA |
| 2451 | SYTL2 | 3385123 | TGCTGCCTCTTATGAATTGACGACAGGTGCAGAGAGAGAATAAACTGTGTCTAAGACTGGAC CAGAGAGTGAGTGTGCTGGAAGCCACCATAGGAACAAGCGACCTGTTTGGCAAGGAATACA GCATCCTTCTGAGAGCCTCTTCTCGACACTATCCCACAGACCAGGACTTCCTCATGGGAAAGA GCACTTAGGATCTTGCTATCAGCTGCCCTAAACTTTTGCTGAGCCAAAATAAGACTTTGATGCA GAACTGAACAAGATATTTCATTTTTGTGTGTTTTAATCTTCCTGGTTGCAGTCTTAGTTGTTCAG CCCTGAGAATTTTGAGCCACATTT |
| 2452 | SYTL2 | 3385127 | AGCGTCCGTCGGGAGAGTGAAGGCTCGCAACGCCTTGCCCGGGGGAAGGTAACGCGCCGCG CCCGGGGCTGCGCGGTTTGCACCGCCAGGCCGAGGGCTGGGGGCCAGAAGACAAGAGAGA CGGCGAGGC |
| 2453 | MMP1 | 3388808 | ATGGATTCATATAGGCCAGAGTTGCAAAGATCTTTTCCAGAGTATGCAACTCTGACGTTGATC CCAGAGAGCAGCTTCAGTGACAAACATATCCTTTCAAGACAGAAAGAGACAGGAGACATGAG TCTTTGCCGGAGGAAAAGCAGCTCAAGAACACATGTGCAGTCACTGGTGTCACCCTGGATAG GCAAGGGATAACTCTTCTAACACA |
| 2454 | MMP1 | 3388809 | AAAGCTAATAGCTGGTTCAACTGCAGGAAAAATTGA |
| 2455 | MMP1 | 3388810 | AACGATCTATGGATCCAGGTTATCCCAAAATGATAGCACATGACTTTCCTGGAATTGGCCACA AGTTGATGCAGTTTTCATGAAAGATG |
| 2456 | MMP1 | 3388812 | ATAAGTACTGGGCTGTTCAGGGACAGAATGTGCTACACGGATACCCCAAGGACATCTACAGC TCCTTTGGCTTCCCTAGAACTGTGAAGCATATCG |
| 2457 | MMP1 | 3388813 | TTCTACCCGGAAGTTGAGCTCAATTTCATTTCTGTTTTCTGGCCACAACTGCCAAATGGGCTTG AAGCTGCTTACGAATTTGCCGACAGAGATGAAGTCCGGTTTTTC |
| 2458 | MMP1 | 3388814 | GCTAACCTTTGATGCTATAACTACGATTCGGGGAGAAGT |
| 2459 | MMP1 | 3388815 | CGTTCCCAAAATCCTGTCCAGCCCATCGGCCCACAAACCCCAAAAGCGTGTGACA |
| 2460 | MMP1 | 3388817 | ACTTACATCGTGTTGCAGCTCATGAACTCGGCCATTCTCTTGGACTCTCCCATTCTACTGATATC GGGGCTTTGATGTACCCTAGCTACACCTTCAGTGGTGATGTTCAGCTAGCTCAGGATGACATTG |
| 2461 | MMP1 | 3388818 | GGGACAACTCTCCTTTTGATGGACCTGGAGGAAATCTTGCTCATGCTTTTCAACCAGGCCCAG GTATTGGAGGGGATGCTCATTTTGATGAAGATGAAAGGTGGACCAACAATTTC |

TABLE 13-continued

Subtyping Target Sequences

| SEQ ID NO. | Gene | Affy Probeset ID | Sequence |
|---|---|---|---|
| 2462 | MMP1 | 3388820 | CCTCACTGAGGGGAACCCTCGCTGGG |
| 2463 | MMP1 | 3388821 | GAATTCTTTGGGCTGAAAGTGACTGGGAAACCAGATGCTGAAACCCTGAAGGTGATGAA |
| 2464 | MMP1 | 3388822 | GCAAGTTGAAAAGCGGAGAAATAGTGGCCCAGTGGTTGAAAAATTG |
| 2465 | MMP1 | 3388825 | AAGAGCAAGATGTGGACTTAGTCCAG |
| 2466 | MMP1 | 3388826 | ATGCACAGCTTTCCTCCACTGCTGCTGCTGCTGTTCTGGGGTGTGGTGTCTCA |
| 2467 | MMP3 | 3388839 | TGAAATGTTCGTTTTCTCCTGCCTGTGCTGTGACTCGAGTCACACTCAAGGGAACTTGAGCGTGAATCTGTATCTTGCCGGTCATTTTTATGTTATTACAGGGCATTCAAATGGGCTGCTGCTTAGCTTGCACCTTGTCACATAGA |
| 2468 | MMP3 | 3388840 | ACAGTTGGAGTTTGACCCAAATGCA |
| 2469 | MMP3 | 3388842 | GGCTTTCCCAAGCAAATAGCTGAAGACTTTCCAGGGATTGACTCAAAGATTGATGCTGTTTTTG |
| 2470 | MMP3 | 3388845 | GCGTGGATGCCGCATATGAAGTTACTAGCAAGGACCTCGTTTTCATTTT |
| 2471 | MMP3 | 3388846 | AACCTGAATTGCATTTGATCTCTTCATTTTGGCCATCTCTTCCT |
| 2472 | MMP3 | 3388847 | TCCTGCTTTGTCCTTTGATGCTGTCA |
| 2473 | MMP3 | 3388848 | TACCCACGGAACCTGTCCCTCCAGAACCTGGGACGCCAGCC |
| 2474 | MMP3 | 3388849 | GATGTACCCACTCTATCACTCACTCACAGACCTGACTCGGTTCCGCCTGTCTCAAGATGATATAAA |
| 2475 | MMP3 | 3388850 | ATTTATTTCTCGTTGCTGCTCATGA |
| 2476 | MMP3 | 3388852 | CAGGGATTAATGGAGATGCCCACTTTGATGAT |
| 2477 | MMP3 | 3388854 | CTGGCATCCCGAAGTGGAGGAAAAC |
| 2478 | MMP3 | 3388855 | ATATCTAGAAAACTACTACGACCTCAAAAAGATGTGAAACAGTTTGTTAGGAGAAAGGACAGTGGTCCTGTTGTTAAAAAAATCCGAGAAATGCAGAAGTTCCTTGGATTGGAGGTGACGGGGAAGCTGGACTCCGACACTCTGGAGGTG |
| 2479 | MMP3 | 3388856 | CAGCCTATCCATTGGATGGAGCTGCAA |
| 2480 | MMP3 | 3388857 | CCAATCCTACTGTTGCTGTGCGTGGCAG |
| 2481 | MMP3 | 3388858 | AGGTTGGACCTACAAGGAGGCAGGCAAGACAGCAAGGCATAGAGACAACATAGAGCTAAGTAAAGCCAGTGGA |
| 2482 | MMP12 | 3388860 | GTCCTCAGTGTACCACTACTTAGAGATATGTATCATAAAAATAAAATCTGTAAACCATAGGTAATGATTATATAAAATACATAATATTTTTCAATTTTGAAAACTCTAATTGTCCATTCTTGCTTGACTCTACTATTAAGTTTGAAAATAGTTACCTTCAAAGGCCAAGAGAATTCTATTTGAAGCATGCTCTGTAAGTTGCTTCCTAACATCCTTGGACTGAGAAATT |
| 2483 | MMP12 | 3388861 | TACTACTATTTCTTCCAAGGATCTAACCAATTTGAATATGACTTCCTACTCCAACGTATCACCAAAACACTGAAAAGCAATAGCTGGTTTG |
| 2484 | MMP12 | 3388864 | GGAGACAGATGATGGACCCTGGTTATCCCAAACTGATTACCAAGAACTTCCAAGGAATCGGGCCTAAAATTGATG |
| 2485 | MMP12 | 3388865 | CTGGTTAATTAGCAATTTAAGACCAGAGCCAAATTATCCCAAGAGCATACATTCTTTTGGTTTTCCTAACTTTGTGAAAAAAATTGATGCAGCTGTTTTTAACCCACGTTTTTATAGGACCTACTTCTTTGTAGATAACCA |
| 2486 | MMP12 | 3388866 | TCCTTATGGCCAACCTTGCCATCTGGCATTGAAGCTG |
| 2487 | MMP12 | 3388870 | TGATGCTGTCACTACCGTGGGAAATAAGATCTTT |
| 2488 | MMP12 | 3388871 | CCAAAAGAGAACCAACGCTTGCCAAATCCTGACAATTCAGAACCAGCTCTC |
| 2489 | MMP12 | 3388872 | TAGTGATCCAAAGGCCGTAATGTTCCCCACCTACAAATATGTTGACATCAACACATTTCGCCTCTCTGCTGATGACATACGTGGCATTCA |
| 2490 | MMP12 | 3388873 | TCCTCACTGCTGTTCACGAGATTGGCCATTCCTTAG |

TABLE 13-continued

Subtyping Target Sequences

| SEQ ID NO. | Gene | Affy Probeset ID | Sequence |
|---|---|---|---|
| 2491 | MMP12 | 3388874 | GCTTTTGATGGCAAAGGTGGAATCCTAGCCCATGCTTTTGGACCTGGATCTGGCATTGGAGG GGATGCACATTTCGATGAGGACGAATTCTGGACTACACATTCA |
| 2492 | MMP12 | 3388876 | CACCTGACATGAACCGTGAGGATGTTGACTACGCAATCCGGAAAGCTTTCCAAGTATGGAGT AATGTTACCCCCTTGAAATTCAGCAAGATTAACACAGGCATGG |
| 2493 | MMP12 | 3388877 | TGGGTCTGAAAGTGACCGGGCAACTGGACACATCTACCCTGGAGATGATGCACGCACCTCGA TGTGGAGTCCCCGATGTCCATCATTTC |
| 2494 | MMP12 | 3388878 | ATGAAATATAGTGGAAACTTAATGAAGGAAA |
| 2495 | MMP12 | 3388879 | AGATAAACAAACTTCCAGTGACAAA |
| 2496 | MMP12 | 3388880 | GTTTCTTCTAATACTGCTCCTGCAGGCC |
| 2497 | MMP12 | 3388881 | ACACAGTAAACTGAATTGATCCGTTTAGAAGTTTACA |
| 2498 | MMP13 | 3388894 | AGTCTACTAGATTGTGATCCCTTGAGATATGGAAGGATGCCTTTTTTTCTCTGCATTTAAAAAA ATCCCCCAGCACTTCCCACAGTGCCTATTGATACTTGGGGAGGGTGCTTGGCACTTATTGAAT ATATGATCGGCCATCAAGGGAAGAACTATTGTGCTCAGAGAC |
| 2499 | MMP13 | 3388895 | GGATATTCAGATGTATGTGCCCTTCTTCACACAGACACTAACGAAATATCAAAGTCATTAAAG ACAGGAGACAAAAGAGCAGTGGTAAGAATAGTAGATGTGGCCTTTGAATTCTGTTTAATTTTC ACTTTTGGCAATGACTCAAAGTCTGCTCTCATATAAGACAAATATTCCTTTGCATATTATAAAG GATAAAGAAGGATGATGTCTTTTTATTAAAATATTTCAGGTTCTTCAGAAGTCACACATTACAA AGTTAAAATTGTTATCAAAATAGTCTAAGGCATGGCATCCCTTTTTCATAAATTATTTGATTAT TTAAGACTAAAAGTTGCATTTTAACCCTATTTTACCTAGCTAATTATTTAATTGTCCAGTTTGTC TTGGATATATAGGCTATTTTCTAAAGACTTGTATAGCATGA |
| 2500 | MMP13 | 3388896 | ATATGACTATGCGTGGCTGGAACCACATTGAAGAATGTTAGAGTAATGAAATGGAGGATCTC TAAAGAGCATCTGATTCTTGTTGCTGTACAAAAGCAATGGTTGATGATACTTCCCACACCACA AATGGGACACATGGTCTGTCAATGAGAGCATA |
| 2501 | MMP13 | 3388897 | TACAGCATCTGGAGTAACCGTATTGTTCGCGTCATGCCAGCAAATTCCAT |
| 2502 | MMP13 | 3388898 | ATATCTATTTTTTCAACGGACCCATACAGTTTGA |
| 2503 | MMP13 | 3388899 | CTGGAGTTCATTGTCGCAATCTGAGCTCGCTGCA |
| 2504 | MMP13 | 3388900 | GGATAAAGACTATCCGAGACTAATAGAAGAAGACT |
| 2505 | MMP13 | 3388901 | AAAATATCTGAACTGGGTCTTCCAAAAGAAGTTAAGAAGATAAGTGCAGCTGTTCACTTTGAG GATACAGGCAAGACTCTCCTGT |
| 2506 | MMP13 | 3388902 | CCTCAGCAGGTTGATGCGGAGCTGTTTTTAACGAAATCATTTTGGCCAGAACTTCCCAACCGT ATTGATGCTGCATATGAGCACCCTTCTCATG |
| 2507 | MMP13 | 3388903 | CCTAAACATCCAAAAACGCCAGACAAATGTGACCCTTCCTTATCCCTTGATGCCATTACCAGTC TCCGAGGAGAAACAATGATCTTTAA |
| 2508 | MMP13 | 3388905 | AGTTCGGCCACTCCTTAGGTCTTGACCACTCCAAGGACCCTGGAGCACTCATGTTTCCTATCTA CACCTACACCGGCAAAAGCCACTTTATGCTTCCTGATGACGATGTA |
| 2509 | MMP13 | 3388907 | CATTCTGAAGTCGAAAAGGCATTCAAAAAAGCCTTCAAAGTTTGGTCCGATGTAACTCCTCTG AATTTTACCAGACTTCACGATGGCATTGCTGACATCATGATCTCTTTTGGAA |
| 2510 | MMP13 | 3388908 | GCTCCATGACTGAGAGGCTCCGAGAAATGCAGTCTTTCTTCGGCTTAGAGGTGACTGGCAAA CTTGACGATAACACCTTAGATGTCATGAAAAAGCCAAGATGCGGGGTTCCTGA |
| 2511 | MMP13 | 3388910 | AGATGATTTGTCTGAGGAAGACCTCCAGTTTGCAGAG |
| 2512 | MMP13 | 3388911 | TCTTCTTGAGCTGGACTCATTGTCGGGCCCTGCC |
| 2513 | MMP13 | 3388912 | CAACAGTCCCCAGGCATCACCATTCAAG |
| 2514 | VSIG2 | 3396085 | TTCTCCCGATCCCTGAGGGCGGTGAGGGGGAATATCAATAATTAAAGTCTGTGGGTACC |
| 2515 | VSIG2 | 3396086 | GGGATCTCTGAGCACACTTGTATGAGGGCTGATTCTAGCAAGGGGTTCCTGGAAAGACCCTC GTCTGCCAGCACCGTGACGACCACCAAGTCCAAGCTCCCTATGGTCGTGTGA |
| 2516 | VSIG2 | 3396090 | AGCGGGTGCCTGCAACCCTCAAACTCCGACATCATTCAGTGTGTTTAGGGGCAGGAGGTGTT GTTCAGCCGTGGAATTTGCTGGTGGCAGCAGTGTAACCTGTGTATTTGAGGGTACAGGCAAG CGGTACAGGGTGGAGTGGCTGGTCCACAAGCTGTGGCAGGGAAGCTGTTTGCAGGACTGCC CTGCC |

TABLE 13-continued

Subtyping Target Sequences

| SEQ ID NO. | Gene | Affy Probeset ID | Sequence |
|---|---|---|---|
| 2517 | VSIG2 | 3396091 | CTGGGCGTGCTGTTGCTGTCAGTTGCTGCGTTCTGCCTGGTCAGGTTCCAGAAAGAGAGGGG GAAGAAGCCCAAGGAGACATATGGGGGTAGTGACCTTCG |
| 2518 | VSIG2 | 3396095 | AGTAATCCCTTATGCAGTCAGAGTGGACAAACCTCTGTGGGAGGCTCTACTGCACTGAGATG CAGCTCTTCCGAGGGGGCTCCTAAGCCAGTGTACAACTGGGTGCGTCTTGGAACTTTTCCTACA |
| 2519 | VSIG2 | 3396096 | TGTACTTCACCAATGGCCATCTGTATCCAACTGGTTCTAAGTCAAAGCGGGTCAGCCTGCTTCA GAACCCCCCCACAGTGGGGGTGGCCACACTGAAACTGACTGACGTCCACCCCTCAGATACTG GAACCTACCTCTGCCAAGTCAACAACCCCACCAGATTTCTACACCAATGGGTTGGGGCTAATCA ACCTTACTGTGCTG |
| 2520 | VSIG2 | 3396098 | TACAGCACGTCGGTGGGAGACAGCTTCGCCCTGGAGTGGAGCTTTGTGCAGCC |
| 2521 | VSIG2 | 3396099 | CCGTGGAGGTGAAGGTACCCACAGAGCCGCTGAGCACGCCCCTGGGGAAGACAGCCGAGCT GACCTGCA |
| 2522 | VSIG2 | 3396101 | CCGAGCTCCCGGGGCCCTTTCTCTGCGGGGCCCTGCTAGGCTT |
| 2523 | VSIG2 | 3396102 | ACCGACCTTGACCGCCCACCTGGCAGGAGCAGGACAGGACGGCCGGACGCG |
| 2524 | VSIG2 | 3396103 | GGCGGCTGCCCTTGGGTGCTCCCTTCCCTGCCCGACACCCAG |
| 2525 | PTMS | 3402742 | AGGGGCCTGAGGATTAGGGAGACACAG |
| 2526 | PTMS | 3402744 | GAGGAGAAGGCAAGCCGGAAAGAGCGAAAGAAAGA |
| 2527 | PTMS | 3402745 | TGGGCAAGGCATGCAGCCAGCCTGAGGCTACTCCCTCTCCTGGTCC |
| 2528 | PTMS | 3402746 | AGAAGAAGAAACTGCCGAGGATGGAGAGGAG |
| 2529 | PTMS | 3402747 | ATGAGGAAGAAGAAGAAGAGGATGATGAAGGGCCCGCGCTGA |
| 2530 | PTMS | 3402749 | TGAAGCGGATCCCAAACGGCAGAAGACAGAAA |
| 2531 | PTMS | 3402750 | CAGCCTTCTCATTTCCGCCTCTCCAGACACTGCGCCCTCCACCCTCACTCTGCCATTGTTCCACC TCCTGACCTGCTCCATCTGAGCTCTCCAGCTGGCCCCCAATTGCTCCTCTC |
| 2532 | PTMS | 3402751 | CTCTCCCACCTAACCTCTGCATCCCCCAGCCTCATGTCCTGCCCCATCCCTATCCTGCCTGATCC CTGGATCTCCCTCAGATCCC |
| 2533 | PTMS | 3402752 | TTGGGGCCGAGCCCCACAGCTGCCCCCCTCCCCTCCCTTTTTGTATAATTTAATAAAGAAATGG TCGCG |
| 2534 | KRT7 | 3415323 | ATGTCCATCCACTTCAGCTCCCCGGTATTCACCTCGCGCTCA |
| 2535 | KRT7 | 3415324 | AGCCTCTACGGCCTCGGCGCCTCACG |
| 2536 | KRT7 | 3415325 | GCCGGCATCCGCGAGGTCACCATTAACCAGAGC |
| 2537 | KRT7 | 3415326 | GGCTGGACGCCGACCCCTCCCTCCAGCGGGTGCGCCAGGAGGAGAGC |
| 2538 | KRT7 | 3415329 | GTGCGGTTTCTGGAGCAGCAGAACAA |
| 2539 | KRT7 | 3415330 | GCAGAAGTCGGCCAAGAGCAGCCGCCTCCCAGACATCTTTGAGGCCCAGATTGCTGGCCTTC GGGGTCAGCTTGAGGCACTGCAGGTGGAT |
| 2540 | KRT7 | 3415333 | GATGAAATTAACCACCGCACAGCTGCTGAGAATGAGTTTGTGGTGCTGAAGAA |
| 2541 | KRT7 | 3415334 | TGAGTGGGAAAGACAGGCTCGAGGAGGGTTGTCTGAAAACATGGGACAAAGGACCACAGG ATCCTCTCACCTGA |
| 2542 | KRT7 | 3415337 | AGTCGCTCCCTGGACCTGGACGGCATCATCGCTGAGGTCAAGGCGCAGTATGAGGAGATGG CCAAATGCAGCCGGGCTGAGGCTGAAGCCTGGTACCAGACC |
| 2543 | KRT7 | 3415339 | CGACCTCCGGAATACCCGGAATGAGATTTCAGAGATGAACCGGGCCATCCAGAGGCT |
| 2544 | KRT7 | 3415340 | GGCTTCCCCTGCTACTTGGGGCATGCAGGG |
| 2545 | KRT7 | 3415341 | CCAGCTGAGGCCAAACTCAGGATGTGGAGCAGGAGGTTCCCATCTCCCGGCCAAAGCTGGTG CCACTGTCTCAGACCCCCTTGTGAGATCTCCAGCACAGAATGTT |
| 2546 | KRT7 | 3415343 | GGCAGGCAGGAAGGCAGACTGGTGAGCCCCAGCTTACAGCTGCACTGCTGCCC |

TABLE 13-continued

Subtyping Target Sequences

| SEQ ID NO. | Gene | Affy Probeset ID | Sequence |
|---|---|---|---|
| 2547 | KRT7 | 3415344 | CTGGCGCTCAAGGATGCTCGTGCCAAGCAGGAG |
| 2548 | KRT7 | 3415349 | TGATGAATTCCACTGGTGGCAGTAGCA |
| 2549 | KRT7 | 3415350 | AAGGCTTATTCCATCCGGACCGCATCCGCCAGTCGCAGGAGTGCCCGCGACTGA |
| 2550 | KRT7 | 3415351 | CAGTCTGGAAAGTGATGTCAGAATAGCTT |
| 2551 | KRT18 | 3415581 | CTGTCCGTGTCCATGCCCGGTTGGCCACCCCG |
| 2552 | KRT18 | 3415582 | GGCTCCGAGCCGTCCACCTGTGGCTCCGGCTTCCGAAGCGGCTCCGGGGCGGGGCGGGGC CTCACTCTGCGATATAACTCGGGTCGCGCGGCTCGC |
| 2553 | KRT18 | 3415583 | CGGCGCCCGGCCGGTCAGCAGCGCGGCCAGCG |
| 2554 | KRT18 | 3415584 | GCTCCACCAGCTTCAGGGGCGGCATGGGGT |
| 2555 | KRT18 | 3415585 | CACCGGGATAGCCGGGGGTCTGGCAGGA |
| 2556 | KRT18 | 3415586 | CTGAACGACCGCCTGGCCTCTTACCTGGACAGAGTGAGGAGCCTGGAGACCGAGAACCGGA GGCTGG |
| 2557 | KRT18 | 3415588 | GCTAAGGCTGAGTCATCTAGGAGTAAACAAGAGGCCTTCCTTTGGGAGGAGCCAATCCAGGG TGTAGGGGGCCCAGAGTGACCAGGTGCACTAGGGAAAAAATGCCAGGAGAGGGCCAGGAA GAGGACTTGTTAGTAGCGACTCACTTCTGGGCAGGCAGGCCAGCCAGCTAGCCAGCCTGCTG AGGCTTCCCAAGAGGGGCAGAGTGCTGGGATCTGGGAATCCAGGAAAGGAGGGAATGGGG TGGGGCTAGATGAAAAGGGATAGGTGTCCAGGGAGAGCCTCTGGCTATTCCTGGGACCAGG AAGTTTTCACTAGGATACATAACACTTTTTACACACTCACCCCACCCATCCCTGGCTTTCTATTC ATGGAACAA |
| 2558 | KRT18 | 3415589 | ATGCCCGCATCGTTCTGCAGATTGACAATG |
| 2559 | KRT18 | 3415590 | GGTGGAGCTAAGAAGGATCTGCTCCCCAGGCTGGGTCAGTTAGGGGCTCACAGTGGGATCCT GTTAGGTGTGGGTGGATGAGAGTCAGGGTCCATCAGTGTATTCATTTAACTGTTCATTTGTAT AACCCCGTTTAAGAATACTGTCCTCCAAGTGCCAAGAATGGTGCTCAGGGGATTACCACCTAA TTGCTGACTCAAGTTGCTGGTTTGCAATGGGCACAGAACTTCTCTTAGTAGGTG |
| 2560 | KRT18 | 3415591 | GCCATGCGCCAGTCTGTGGAGAACGACATCCATGGGCTCCGCAAG |
| 2561 | KRT18 | 3415592 | TGATGACACCAATATCACACGACTGCAGCTGGAGA |
| 2562 | KRT18 | 3415596 | GGCTCGGAAGAACCGAGAGGAGCTAGACAAGTACTGGT |
| 2563 | KRT18 | 3415597 | AGGGAGGCAGACGGAATGAGGGGCCTGAT |
| 2564 | KRT18 | 3415598 | GGTCACCACACAGTCTGCTGAGGTTGGAGCTGCTGAGACGACGCTCACAGAGCTGAGACGT |
| 2565 | KRT18 | 3415599 | CACATAGCAGGTGCCCAAAAAAGTTTCCAAAAGTGAAGGGATGAGCAG |
| 2566 | KRT18 | 3415600 | TCCTGGGACTCTGGGCTCACCCTGCCCCTCC |
| 2567 | KRT18 | 3415601 | CCCGCTACGCCCTACAGATGGAGCAGCTC |
| 2568 | KRT18 | 3415602 | TGCTGGAAGATGGCGAGGACTTTAA |
| 2569 | KRT18 | 3415603 | TCCTACCCACACGTGCTGGGATCAGGAGATCACTTCTCCCCAAAGTCTGAGCTTTTGGAAGCA CCCCATGTGTCTGTTCACTGGTATCCACTGAGCACTGGGCCGTTGCTCCGTGGGTGCTCCTGT GTCTTCAAGGGAGTAACAGTTACAGAGGTCTCCCCCTTGAAGAAAGCAAACTAAGTATTGTCC CTAGCTGTACTTAGTATGCAAATGAAGTTTGGCCTTGAGTTTCCCTTTTCTGGAGGAAGAGGC TGAGGGTGATTTGGAGATAAAGGTAGAGGTCAGGAGGCTTTTTCCCTCTACCTTTCTTGTCTC CCTTCTACTCCACGGGGCTGTTTATAACTTG |
| 2570 | KRT18 | 3415604 | GCCTTGGACAGCAGCAACTCCATGCAAACCATCCAAAAGACCACCACCCGCCGGATAGTGGA TGGCAAAGT |
| 2571 | KRT18 | 3415606 | GGAGCAGGAGGCCAATAAAAAGTTCAGAGT |
| 2572 | CPSF6 | 3421447 | TGCTGCCGCGGCGGGCAGACCTGCAGGAG |
| 2573 | CPSF6 | 3421458 | ATGGAGATGCCCCAGAAGACCGAGATTACATGGATACTCTCCCACCAACTGTTGGTGATGAT GTGGGTAAAGGAGCAGCACCAA |
| 2574 | CPSF6 | 3421459 | TTGAAAATCGGGCAAATGGCCAGTCAAAGG |

TABLE 13-continued

Subtyping Target Sequences

| SEQ ID NO. | Gene | Affy Probeset ID | Sequence |
|---|---|---|---|
| 2575 | CPSF6 | 3421462 | TGCCCTTGTTGGTGTTGGATCTGAAGCATCTTCAAAAAAGTTAATGGATCTGTTACCTAAAAG<br>AGAACTTCATGGTCAGAATCCTGTTGTAACTCCATGCAATAAACAGTTCCTGAGTCAATTTGA<br>AATGCA |
| 2576 | CPSF6 | 3421466 | CTACACAATCAGGACAAATGTCTGGGG |
| 2577 | CPSF6 | 3421467 | CAGGAGGCAGTTCCCGTGCAGCATTTCCACAAGGTGGTAGAGGACGGGGC |
| 2578 | CPSF6 | 3421468 | TTACCATGGATAAAACATGTCTACCTAATACCTCTTTTCCTTTTCTCTCTTTTTCAAGTAATGCAT<br>TATTAATGTGACTTACTCTCCTTGTTATGCT |
| 2579 | CPSF6 | 3421469 | AGCATCTTGTTAAAGGAACTCGGCCTTTGTTCCTGGAAACTAGGATTCCATGGCATATGGGGC<br>ACAGCATAGAGGAAATACCCATTTTTGGC |
| 2580 | CPSF6 | 3421471 | CCACGTCCACCCTTAGGTCCTCCAG |
| 2581 | CPSF6 | 3421472 | CTCTAGCTGGGCCTCCTAATCGAGGAGATCGCCCTCCACCACCAGTTCTTTTTCCTGGACAACC<br>TTTTGGGCAGCCTCCATTGGGTCCACTTCCT |
| 2582 | CPSF6 | 3421473 | TCCGCATGTGAACCCAGCTTTCTTTCCTCCACCAACTAACAGTGGCATGCCTACATCAGATAGC<br>CGAGGTCCACCACCAACAGATCCATATGGGCGACCTCCACCATATGATAGG |
| 2583 | CPSF6 | 3421474 | GGAAATGGATACTGCAAGAACGCCATTGAGTGAAGCTGAATTTGAAGAAATCATGAATAGAA<br>ATAGGGCAATCTCAAGCAGTGCTATTTCGAGAGCTGTGTCTGATGCCA |
| 2584 | CPSF6 | 3421475 | TGATTATGGGAGTGCTATTGAGACACTGGTAACTGCAATTTCTTTAATTAAACAATCCAAAGT<br>ATCTGCTGATGATCGTTGCAAAGTTCTTATTAGTTCTTTGCAAGATTGCCTTCATGGAATTGAG<br>TCCAAGTCT |
| 2585 | CPSF6 | 3421477 | AGAGGGACCATAGTAGATCACGAGAAAAGAGTCGACGTCATAAATCCCGTAGTAGAGACCG<br>TCATGACGATTATTACA |
| 2586 | CPSF6 | 3421478 | TGACCGAGAGCGCGAATATCGTCATC |
| 2587 | CPSF6 | 3421489 | GAAGAGGATCACCTTCCAAGACAAAACAGTCTTCATGGGGGAAAAATGACGCTTGTCCAGCA<br>GTTTGCTTCTTGTGATTGAACTGAACCTGTAAGGATTCATGGATAAAATGAACAGGA |
| 2588 | CPSF6 | 3421490 | TTTATTTGAAGGAAACCTGTGTGATTTAAAAAGTTATAGCTTTTGCAACTTTATTACTGGTTAT<br>ATACATTTGGCCATTATGATGTGCAAGCAATTGGAAAAAAAGTCAAGTAAATGCTTGTTTTTG<br>TAGTAGTTTGTTCTTGTTAAAAATGTTTATATGATAATGTCTGTAAACAGCATCACTTTGAT |
| 2589 | CPSF6 | 3421491 | TACAATAGATGTAGTGTTGTAATAAACTGTTTAA |
| 2590 | CPSF6 | 3421492 | CTCAGGGAAAGTCTTGTGTTCAGCAATATCTAAAGATAATGTTACTATGACAACATTTTTACTG<br>TCCTTTAAAGCATTGCAATAGCGTTTTTGGATATGCCTCAATCTAATCTTGCGTTCAGTGAATT<br>AAACATAGTA |
| 2591 | CPSF6 | 3421493 | GCACCTGACTAGCATGTGTTCTTGATTGCAAAATTGGCAGAGGCAGGGTGTCAACTTGATTAG<br>GTGTTTTTATGGGAATGTAATTTGAAATCACTACTTCAGAAATTTGACTTAAAATTCTTGAGCA<br>CGTTAATATGTTTTTAAGATCTGATTATCTTTGAGAGATCTTCTGTTAATACACATTGGTTGTTA<br>AAGAGTACCCAAATTCTAGGACAATGCTTAAAGTGTTAAAATACCCTAGATACTGTGTTATGT<br>GCAACTGTAGAAACCCTCCAGAAATTTCCACTGCTGTTCTTCACTTTCATCTTGTCTGCTATCAA<br>ACCACTTCTGACAAAATTAGCTGTTTTGAATTACCCATATCACTGCCAGTTTTATTTTAAAATAT<br>TTTGTGTTTGAAGTATCTGTGCATGGGATCGTTGATGTTTATCAGAACTGTTCACTTTCAGAAA<br>TGATTTTTTAAAGCATTTTGTTGAAAATGCGGTTGCTTTTTTAACATTATTTTAGAGTTGTATCA<br>AAATTTTCCTGTTTTCTGTATATTGTTGTGTCATTTCTTGGCTTTTTAATATTTTGACTACAATGC<br>CCTAATGCGAAGAAGTATGGAC |
| 2592 | CPSF6 | 3421494 | ACTTTCGTTACAGACAGTGTGAGTGTACTAGATTTGTTTGCTGCTAATCCGTTATTTTAAGTGT<br>TGTCAGAAGGAAATAACTTCTTGGTTTGACCAAGTAATTTTGCAAAGTCCTTCTCTACCTGATA<br>ACACGTGAATGTATA |
| 2593 | CPSF6 | 3421495 | ACAAGACTTTTCTGTTGGAGTGCTCTCGACATTTTGGTTTTCATACCTGAATGATCATTGCATTT<br>TCTGTATTTTCTAAAATGGCTCCAATTTTGTGTTTTAAGCTTCAGCTTAAGAGGAAGTTTATGTT<br>CTAATTCTTGACTGAGAATACAGTATTGAGATTCTCTGTTTTACAGATAACAACTGGTTTTTATT<br>ACTCATTAAGTTCATTTGCATCCCGTAGCCCTCTGTAAATGTTTCCCCTAGTTGTATGTACGTAA<br>ATGCACGCTTATCCAGTGTATATTAGACATTTTTGTGCTAAAATATATTAAGTGGGATTTTGT<br>AGCAAAGCATTCTATTTTTCTGTTCTTACAGTGTGTGTGTGTGTGTGTGTGTATGCGT<br>TTTTTAACCTTAACTTCAGTTTAAACACTTGTATTTATTTTTTTAAGCAACTTGACTCTTAGA<br>AGCCTTAGACTGATTTTTTCAATAAATATTCAACCAAAAATTATAAATTTATTAAGATGTGGCC<br>TTACATATGGCATTCCTTGTGTTCGTAATGTGAGATTTTTGATTTAGATAAATCAAGATTCAGG<br>ATTAAAGTTTCATTGTAAGTTGAAATAGAAAATGTATTAAAATGTCTAGGCTTCGGGAGGAA<br>GTTCTTATACTCTTCTTCTTGGCATTAGAAAGAAGCAATATGAATTTTTGTGAATATTCTAAAT<br>ATTCAGGCAACACTGTTCAGATTGATTTAGGTTTGTCTTAACCAATGTTCTTTTTTTAGAATTTC |

TABLE 13-continued

Subtyping Target Sequences

| SEQ ID NO. | Gene | Affy Probeset ID | Sequence |
|---|---|---|---|
| | | | AGGTTGTGTGGCATTCACTGAGTATGCAGCTACTATGGTTTTTGTATGGGACGTATAAATACTTG ATTATATACGACAGATTTTAATGTCTTTAAAGACTTCCTGCTGTATTAACATATTGTAATGGAG TCTTTTAAATACTAGGTTGAATTTAATTGAAGTCACACACATCTTGAAGTGGTAACTGCATAGT AAATACTACCAAGAGTTTTTTTCACGTGGGAGTATCCTAAAACTCTGCCATGGGTGTAAATGT TTTACATTAATTTCATAATTGGACAGACCCTGCATTTAGCGAAAA |
| 2594 | LYZ | 3421512 | GGTCAGCCTAGCACTCTGACCTAGCA |
| 2595 | LYZ | 3421513 | GCTTGTCCTCCTTTCTGTTACGGTCCAGGGCAAGGTCTTTGAAAGGTGTGAGTTGGCCAGAAC TCTGAAAAGATTGGGAATGGATGGCTACAGGGGAATCAGCCTAGCAAAC |
| 2596 | LYZ | 3421515 | AATGGGAGAGTGGTTACAACACACGAGCTACAAACTACAATGCTGGAGACA |
| 2597 | LYZ | 3421516 | TTCAGATCAATAGCCGCTACTGGTGTAATGATGGCAAAACCCCAGGAGCAGTTAATGCCTGTC ATT |
| 2598 | LYZ | 3421519 | CTGCAAGATAACATCGCTGATGCTGTAGCTTGTGCAAAGAGGGTTGTCCGTGATCCACAAGG CATTAGAGCA |
| 2599 | LYZ | 3421520 | GGTGGCATGGAGAAATCGTTGTCAAAACAGAGATGTCCGTCAGTATGTTCAAGGT |
| 2600 | LYZ | 3421521 | GTGAAAGGTCACACTACCATTATTTCCCCTTCAAACAAATAATATTTTTACAGAAGCAGGAGC AAAATATGGCCTTTCTTCAAGAGATATAATGTTCACTAATGTGGTTATTTTACATTAAGCCTA CAACATTTTTCAGTTTGCAAATAGAACTAATACTGGTGAAAATTTACCTAAAACCTTGGTTATC AAATACATCTCCAGTACATTCCGTTCTTTT |
| 2601 | LYZ | 3421522 | CCGGCCACATTCAGTTCTTATCAAAGAAATAACCCAGACTTAATCTTGAATGATACGATTATGC CCAATATTAAGTAAAAAATATAAGAAAAGGTTATCTTAAATAGATCTTAGGCAAAATACCAGC TGATGAAGGCATCTGATGCCTTCATCTGTTCAGTCATCTCCAAAAACAGTAAAAATAACCACTT TTTGTTGGGCAATATGAAATTTTTAAAGGAGTAGAATACCAAATGATAGAAACAGACTGCCTG AATTGAGAATTTTGATTTCTTAAAGTGTGTTTCTTTCTAAATTGCTGTTCCTTAATTTGATTAAT TTAATTCATGTATTATGATTAAATCTGAGGCAGATGAGCTTACAAGTA |
| 2602 | SCNN1A | 3441886 | AGAGCCGCCCAAACTGCCGTTGATGTGTGGAGGGAAGCAAGATGGGTAAGGGCTCAGGAA GTTGCTCCAAGAACAGTAGCTGATGAAGCTGCCCAGAAGTGCCTTGGCTCCAGCCTGTACCC CTTGGTACTGCCTCTGAACACTCTGGTTTCCCCACCCAACTGCGGCTAAGTCTCTTTTTCCCTTG GATCAGCCAAGCGAAACTTGGAGCTTTGACAAGGAACTTTCCTAAGAAACCGCTGATAACCA GGACAAAACACAACCAAGGGTACACGCAGGCATGCACGGGTTTCCTGCCCAGCGACGGCTTA AGCCAGCCCCCGACTGGCCTGGCCACACTGCTCTCCAGTAGCACAGATGTCTGCTCCTCCTCTT GAACTTGGGTGGGAAACCCCACCCAAAAGCCCCCTTTGTTACTTAGGCAATTCCCCCTTCCCTG ACTCCCGAGGGCTAGGGCTAGAGCAGACCCGGGTAAGTAAAGGCAGACCCAGGGCTCCTCT AGCCTCATACCCGTGCCCTCACAGAGCCATGCCCCGGCACCTCTGCCCTGTGTCTTTCATCCT CTACATGTCTGCTTGAGATATTTCCTCAGCCTGAAAGTTTCCCCAACCATCTGCCAGAGAACTC CTATGCATCCCTTAGAACCCTGCTCAGACACCATTACTTTTGTGAACGCTTCTGCCACATCTTGT CTTCCCCAAAATTGATCACTCCGCCTTCTCCTGGGCTCCCGTAGCACACTATAACATCTGCTGG AGTGTTGCTGTTGCACCATACTTTCTTGTACATTTGTGTCTCCCTTCCCAACTAGACTGTAAGTG CCTTGCGGTCAGGGACTGAATCTTGCCCGTTTATGTA |
| 2603 | SCNN1A | 3441887 | CCCACCCCATGTCTCTGTCCTTGTCCCAGCCAGGCCCTGCTCCCTCTCCAGCCTTGACAGCCCCT CCCCCTGCCTATGCCACCCTGGGCCCCCGCCCATCTCCAGGGGGCTCTGCAGGGGCCAGTTCC TCCACCT |
| 2604 | SCNN1A | 3441888 | GGCTGAGCTCGTCTTTGACCTGCTGGTCATCATGTTCCTCATGCTGCTCCGAAGGTTCCGAAG CCGATACTGGTCTCCAGG |
| 2605 | SCNN1A | 3441889 | GAACTACAAAACCAATTCTGAGTCTCCCTCTG |
| 2606 | SCNN1A | 3441890 | ATGCTATCGCGACAGAACAATTACACCGTCAACAACAAGAG |
| 2607 | SCNN1A | 3441891 | TCTCTGCTGGTTACTCACGATGGCCCTCGGTGACATCC |
| 2608 | SCNN1A | 3441892 | CTGGGCTGTTTCACCAAGTGCCGGAAGCCATGCA |
| 2609 | SCNN1A | 3441895 | GAGTGTGGCTGTGCCTACATCTTCTATCCGCGGCCCCAGAACGTGG |
| 2610 | SCNN1A | 3441896 | GATGTTCCTGTTGAGAACCTTTACCCTTCAAAGTACACACAGCAG |
| 2611 | SCNN1A | 3441897 | TGGACAGACTTGGGGGCGATTATGGCGACTGCAC |
| 2612 | SCNN1A | 3441898 | TGGAGACCTCCATCAGCATGAGGAA |
| 2613 | SCNN1A | 3441899 | TGATGGTGGCTTAACTTGCGGCCTGGC |
| 2614 | SCNN1A | 3441900 | GTCTGTCCCTGATGCTGCGCGCAGAGCAGAATGACTTCATTC |

TABLE 13-continued

Subtyping Target Sequences

| SEQ ID NO. | Gene | Affy Probeset ID | Sequence |
|---|---|---|---|
| 2615 | SCNN1A | 3441902 | TTACTCTCACTTCCACCACCCGATGTATGGAAACTGCTATACTTTCAATGAC |
| 2616 | SCNN1A | 3441904 | TCGGACTGCTTCTACCAGACATACTCATCAGGGGTGGATGCGGTGAGGGAGTGGTACCGCTT CCACTACATCAACATCCTGTCGAGGCTGCCAGAGACTCTGCCATCCCTGGAGGAGGACACGCT GGGCAACTTCATCTTC |
| 2617 | SCNN1A | 3441906 | TGGACCGCATCACAGAGCAGACGCTCTTTGACCTGTACAAATACAGCTCCTTCACCACTCTCGT GGCCGGCTCCCGCAGCCGTCGCGACCTGCGGGGGACTCTGCCGCACCCCTTGCAGCGCCTGA GGGTCCCGCCCCCGCCTCACGGGGCCCGTCGAGCCCGTAGCGTGGCCTCCAGCTTGCGGGAC AACAA |
| 2618 | SCNN1A | 3441907 | ACCGACACTCGCCTGCGGGGATCAGGGCGGGATGACCTGGGTACCGCGGTCACGCCAAGGC CGAGGCCCTCACCCTTCCCCTCTTTGGGAAAGGGCAGACAAGTTCCGGGTTCCCTTCTAGGTC CGGGCGAGGGGGAGAGCGCCCCACAGACGACGAGGCGCCTCCTGCCTCTCTCCTTCAATAAAC AGTCCACAGTGTCCCGGCTGGGCTCGCCGTGGCCTCCGCCTTCCCGGCGGACACACCTGTTTA CCCTTCACCGCCGGACGGCCAGGAGGCGCCACGACGACCCCAGCCCCGCCCAGGCTTCTCCG GGATGGACCGGCCTCCCGGGGCACAGATGAGGACCCTGACCCCGGAGGGGCCAGACACTCG CTCCAGGGC |
| 2619 | SCNN1A | 3441910 | GAGGCCCTGATCGAGTTCCACCGCTCCTACCGAGAGCTCTTCGAGTTCTTCTGCAACAACACC ACCATCCACGGCGCCATCCGCCTGGTGTGCTCCCAGCACAACCGCATGAAGACGGCCTTCTGG GCAGTGCTGTGGCTCTGCACCTTTGGCATGATGTACTGGCAATTCGGCCTGCTTTTCGGAGAG TACTT |
| 2620 | SCNN1A | 3441911 | GGAGGAGCAGGACCCTAGACCTCTGCAGCCCATACCAG |
| 2621 | SCNN1A | 3441913 | CCGGCCAGCGGGCGGGCTCCCCAGCCAGGCCGCTGCACCTGTCAG |
| 2622 | SCNN1A | 3441915 | CAAGGGAACCTGGTTTGGAATCCTGGTTGACACCGGCTTTCACTTTAAGAAGTCGCAAGAGA CTGCCGCAAGAGAGG |
| 2623 | MGP | 3445744 | GAGAGTCAACATATGTGATTGTTCCATAATAAACTTCTGGTGTGA |
| 2624 | MGP | 3445745 | GCAGCATTACAGAAATACATAGGCTTATATACAATGCTTCTTTCCTGTATATTCTCTTGTCTGG CTGCACCCCTTTTTCCCGCCCCAGATTGATAAGTAATG |
| 2625 | MGP | 3445749 | CAGAGATGGAGAGCTAAAGTCCAAGAGAG |
| 2626 | MGP | 3445750 | TCCCTTCATTAACAGGAGAAATGCAAATACCTTCATATCCCCTCAG |
| 2627 | MGP | 3445751 | TGGGATTTAAGCTACAGGCGACATATTTAGAAGCCATAAAATCTCATTTGGAAATTTTAAATT GGCACCACGTCAACTGCACAGATGGAAAACGAGGAGTAATGACAAATGGTAAAGCACAGAG CTGGACGCCAAGTCAGCTGGGAGACCACAGGCGCCACGTTAAGCTGAGTGCTGTTTTGGTTT TTTTGTGTTTTTCTTTCTTGTTTTTTTTTTGAGACAGTGTCTCACTCTGTCGCCCAGGCTAGAGT GCAGTGGTGTGATCTCGGCTCGCCGCAACCTCCACCTCCCAGGTTCAGGCAATTCTCATGCCT CAGCCTCCTGAGTAGCTGGGATTACAGGCCCATGACATCATGCCTGGCTAATTTTTGTATTTTT AGTAGAGATGGGGTTTCACCATGTTGTCCAGGCTGGTCTCGAACTCCTGGCCTCAAGTGATCC ACCCACCACAGCCTCCCAAAGTGCCGGGATTACAGGCATGAGCCACCACACCCAGCCAGCTG ATTGCTGTTGAATAGCTGGATTTATAAAGACTGAGCATAGGAGGAAATGGCACATCACTCTCA TTTTTAATTTATTCATTATTTTTATAGTGTTTAAACTGTTCATGTATCGGCAATCTAGTTATGCTT CATAAATCCTCAGGACAGAGAATTTCTCCTCAAAAGGAATTTAAAATCTACCAAGTAGAAATA CAGAAATTAAGAAAGGCAAAGTGATCGTCCAAACTCAAAACCAACAAAGCCTATATGACAAG TCTCTAAGACACATGGATTGATTACTGATTTCATTTGATCAGGAAGTTAATGAAATCTACTTTA TACTCTCCTTTAATTTTTGCCAATCTCCGTTTATATGAGTTGCATAAGTTAAGGCACTTTCAAAT ATATTTGTGTCAAGGAATATTCACGGAAATATTTCCAGCTATGTGTCGCTAAAACTGC |
| 2628 | MGP | 3445754 | AGAAGAAAACTTCGGCTTTGATATCGTTTCAGTTCTCTCTCTGAACTGGCATCGTGCCCAGG |
| 2629 | MGP | 3445755 | CCTGGCCGCCTTAGCGGTAGTAACTTTGTGTTATG |
| 2630 | MGP | 3445756 | CTGCTGCTACACAAGACCCTGAGACTGACCTGCAG |
| 2631 | MGP | 3445757 | CCTCACAGCCTTCCACTAACATCCCGTAG |
| 2632 | ERP27 | 3445769 | ATCTCCAACTCCCTATGTAAATCAACAACCTGCATAATAAA |
| 2633 | ERP27 | 3445770 | AGTTAAAGGCTGTCTCCAAGTCCCTGAACTCAGCAGAAATAGACCATGTGAAAACTCCATGCT TGGTTAG |
| 2634 | ERP27 | 3445771 | TATCGTGCATTCATACTCTGTAAGCCCATCTGTAACACACCTAGATCAAGGCTTTAAGAGACTC ACTGTGATGCCTCTATGAAAGAGAGGCATTCCTAGAGAAAGATTGTTCCAATTTGTCATTTAA TATCAAGTTTGTATACTGCACATGACTTACACACAACATAGTTCCTGCTCTTTTAAGGTTACCTA AGGGTTGAAACTCTACCTTCTTTCATAAGCACATGTCCGTCTCTGACTCAG |

TABLE 13-continued

Subtyping Target Sequences

| SEQ ID NO. | Gene | Affy Probeset ID | Sequence |
|---|---|---|---|
| 2635 | ERP27 | 3445772 | AAGAAAATCGTGAATCAGAAGGAAAGACTCCAAAGGTGGAACTCTGA |
| 2636 | ERP27 | 3445773 | AGGAGTCTCAACTGCCAGCTTTGGCAATTTACCAGACTCTAGATGACGAGTGGGATACACTGCCCACAGCAGAAGTTTCCGTAGAGCATGTGCAAAACTTTTG |
| 2637 | ERP27 | 3445774 | GATTTCAATTTCATGGTGCAGACCATAAATTCAATCAGTGTGAGCTGCAACAATTACAAGGTATCTCTTTATCCCTGGACGTCACCTCAGATAGAACTTTT |
| 2638 | ERP27 | 3445775 | ATGAACAAGGCCTCCCCAGAGTATGAAGAGAACATGCACAGATACCAGAAGGCAGCCAAGCTCTTCCAGGGG |
| 2639 | ERP27 | 3445776 | GGTTATTCAACAGCGTAATTCAGATTCATCTCCT |
| 2640 | ERP27 | 3445777 | ACAACTGAATTTAGAGGACGAAGACATTGAAAGCATTGATGCCACCAAATTGAGCCGTTTCATTGAGATC |
| 2641 | ERP27 | 3445778 | CACATCAAATGTTAAACGAGTCCTGATTATGATGATAATGATGATGATTTTGGTGGTTGCAATAGCAAAGCCTTAAGTATGAAGGAGACTTGCCAGCTGG |
| 2642 | ERP27 | 3445780 | CCATACTCCATAGCATGGTGCAAAAATTCCCAGGCGTGTCATTTGGGATCAGCACTGATTCTGAGGTTCTGACACACTACAACATCACTGGGAACACCATCTGCCTCTTT |
| 2643 | ERP27 | 3445781 | CACTGAGGTGGCTGTCATAGGCTTCT |
| 2644 | ERP27 | 3445783 | GTGAGCTGGCTGCAGAAGTTGCTGCAGAAGTTGAGAAATCCTCAG |
| 2645 | ERP27 | 3445784 | GGTTCATGTTCCTCTTATTTCTCCTCACGT |
| 2646 | ERP27 | 3445785 | TTCTACCTTGTGTTGCCTGGCAAAATCTTACTTACCCAGAACTCTGCTCCGGCATCCTCCGCAGGAAGAACACTTTCATTGAACCCTAGCATTGTCCCTAATACCCTTAATATGTATTGTCATAGCACCCTATGAATTTTCTATATCACTTTCCATCTTATATTTAAATAATCTTTTTACTTGCCCATCTCTCCCACTGATAATCTAAGCTGGCAGAGGCTGGATCAGATCATAATTATCTTTCTATTCTTAGCGCTAGGATCAATGCCTGG |
| 2647 | KRT5 | 3455207 | CCTTTTCTGGAGAGTAGTCTAGACCAAGCCAATTGCAGAACCACATTCTTTGGTTCCCAGGAGAGCCCCATTCCCAGCCCCTGGTCTCCCGTGCCGCAGTTCTATATTCTGCTTCAAATCAGCCTTCAGGTTTCCCACAGCATGGCCCCTGCTGACACGAGAACCCAAAGTT |
| 2648 | KRT5 | 3455208 | TCTTGCCGGAGGTAGCAGTGGAAGCTACTACTCCAGCAGCAGTGGGGGTGTCGGCCTAGGTGGTGGGCTCAGTGTGGGGGCTCTGGCTTCAGTGCAAGCAGTGGCCGAGGGCTGGGGGTGGGCTTTGGCAGTGGCGGGGTAGCAGCTCCAGCGTCAAATTTGTCTCCAC |
| 2649 | KRT5 | 3455211 | ACTCAGTGGAGAAGGAGTTGGACCAGTCAACATCT |
| 2650 | KRT5 | 3455212 | AGGTCAATCCCTCTTCATTGGAAAATCCCTCTGGAGAGTTCTCCCTTCCTTTAACTTAAGCAGCTTTTGGGTGTACAGACTCCTGGCTTATGGAATGAACTCGAATCATGAGGATGGGAGTTAGCCACATAGACTAATGCTGTCTTTTTGGGAGCTGTTAACCCTTAATTCA |
| 2651 | KRT5 | 3455214 | CAAGATGGCCTTCAGCTGATAAAGCGAAGCTGCTCTACTGTGGGGTGTACAACACACATACATGAGATCAGTGACTTGTGCGTGATAATGACACATCATCAACACTATTTCAGTCTGACTCATGGCCATATAGCTGACCTCAACTCACTTTTCTGGTCTCTTTTCCCCCACCGGTGTTCCTGGGCACTGGCTGTCCTCCAAGCACCTGAGCAACTCAGCAATCTTCTTGACACTTGTGCCTTTTCTGCTTTTGCTCACGTCCTTTGCTCAACCTCAATATCCATGTCATG |
| 2652 | KRT5 | 3455215 | TGCGCCAATCTGCAGAACGCCATTGCGGATGCCGAGC |
| 2653 | KRT5 | 3455216 | CTTTTGCTAAACACACGCAGCTAGATCCAGTACCAGTGTTTCAGTGTCCTGCCACCCACGATGTACTGGTTTCTCTCTGGGATTCATGATAGTTTGGTTTGTCTGACCCAGAAACTCAG |
| 2654 | KRT5 | 3455217 | AGCTGGCCGGCATGGCGATGACCTCCGCAACACCAAGCATGAGATCTCTGAGATGAACCGGATGATCCAGAGGCTGAGAGCCGAGATTGACAATGTCAAGA |
| 2655 | KRT5 | 3455219 | CAGATGCAGACGCATGTCTCTGACACCTCAGTGGTCCTCTCCATGGACAACAACCGCAACCTGGACCTGGATAGCATCATCGCTGAGGTCAAGGCCCAGTATGAGGAGATTGCCAACCGCAGCCGGACAGAAGCCGAGTCCTGGTATCAGACCAAG |
| 2656 | KRT5 | 3455220 | CAGAACCAGATGACCGACTCCAAATCTCCCTG |
| 2657 | KRT5 | 3455222 | GGCCAAGGTTGATGCACTGATGGATGAGATTAACT |
| 2658 | KRT5 | 3455223 | GCAGCCTGCAGCTATGCTCTCTAAGCGTGGAGCTCACTTGAGTAGGGTGACGGTGTGT |
| 2659 | KRT5 | 3455224 | TGAAATCAACAAGCGTACCACTGCTGAGAATGAG |

TABLE 13-continued

Subtyping Target Sequences

| SEQ ID NO. | Gene | Affy Probeset ID | Sequence |
|---|---|---|---|
| 2660 | KRT5 | 3455225 | AAAAGAACACTAGAGAAATTGACTAG |
| 2661 | KRT5 | 3455228 | GTGGACACGTTCTGAATTAGACTGGCAGCTGGGAAG |
| 2662 | KRT5 | 3455229 | CAACCTGCAAATCGACCCCAGCATCCAGAGGGTGAGGACCGAGGAGCGCGAGCAGATCAAGA |
| 2663 | KRT5 | 3455230 | GAGGTGGTGCCGGTAGTGGATTTGGTTTCGGCGGTGGAGCTGGTGGT |
| 2664 | KRT5 | 3455231 | GGCAGCTTCAGGAACCGGTTTGGTGCTGGTGC |
| 2665 | KRT5 | 3455232 | GGGCTCCAAGAGGATATCCATCAGCACTAGTG |
| 2666 | KRT5 | 3455233 | TGTGGAGTGGGTGGCTATGGCAGCCGGAGCCTCTACAACCTGGG |
| 2667 | KRT5 | 3455234 | TGGTGGCTTCGGCAGGGTCAGCCTTGCGG |
| 2668 | KRT5 | 3455235 | TCAAGTGTGTCCTTCCGGAGCGGGGGCAGTCGTAGCTTCAGCACCGCCTCTGCCATCACCCCGTCTGTCTCCCGCACCAG |
| 2669 | KRT5 | 3455236 | ACAGCTCGACAGCTCTCTCGCCCAGCCCAGTTCTGGAAGGGATAAAAAGGGGGCATCACCGTTCCTGGGTAACAGAGCCACCTTCTGCGTCCTGCTGAGCTCTGTTCTCTCCAGCACCTCCCAACCCACTAGTGCCT |
| 2670 | KRT5 | 3455237 | CCCAGCCTCTATGGTGAAGACATACTTGCTAGCAGCGTCACCAACTTGCTGCCAAGAGATCAGTGCTGCAAGGCAAGGTTATTTCTAACTGAGCAGAGCCTG |
| 2671 | KRT8 | 3455567 | GGCTCAGCCCTAGCCCTCAGCCCACCTGGGGAGTTTACTAC |
| 2672 | KRT8 | 3455568 | CCGCTATGCAGGGTAGCACTGGGAACA |
| 2673 | KRT8 | 3455569 | CCTCCCAGCCTACCCCTCCTGCGCTGCCCCAG |
| 2674 | KRT8 | 3455570 | TCTGAGTCCTCTGACGTCCTGCCCA |
| 2675 | KRT8 | 3455571 | AGCTCCTCCAGGGCCGTGGTTGTGAAG |
| 2676 | KRT8 | 3455575 | GGATGCAGAACATGAGTATTCATACGAAGACCACCAGCGGCTATGCAG |
| 2677 | KRT8 | 3455576 | TGGGACTTGGGGTCCTGTTGTTCTGGGCCAAGAAGGGCTAGGAGTTGGTCCTGACACCCCA |
| 2678 | KRT8 | 3455577 | GTGGGTACCTCTGACCGGACCTGCTTCCCTATCCCT |
| 2679 | KRT8 | 3455578 | CGCCATTGCAGATGCCGAGCAGCGTGGAGAGCTGGCCA |
| 2680 | KRT8 | 3455580 | CGGGGATGACCTGCGGCGCACAAAGACTGAGATCTCTG |
| 2681 | KRT8 | 3455581 | GTACCAGATCAAGTATGAGGAGCTGCAG |
| 2682 | KRT8 | 3455582 | ACAGTACGAGGATATTGCCAACCGCAGCCGGG |
| 2683 | KRT8 | 3455584 | TCTCGCCTGGAAGGGCTGACCGACGAGATCAACTTCCT |
| 2684 | KRT8 | 3455585 | TTGGACAGAACTCTTGACATCGGTGTTGGGACATGGTTCAGAAAACAGAGCAGTAGAACTGGAGATCTGGCTCTAGAAGGCTCCCTAGAGAAGGAGGTGGAAGAGGGTGTGTTGCAGGAAGCAGAGGTGAAGGTGTGTGGGCTGAGAATGCACATGTGATGGGCAGAGGCTGGGCTGGAAGATCAATCCACAAAGTGGGCAACTAGAAAGTCCTGTGACC |
| 2685 | KRT8 | 3455586 | ATAAGCGTACAGAGATGGAGAACGAATTTGTCCTCAT |
| 2686 | KRT8 | 3455587 | GGTGACCACCTGATGAGGTTTGCTCGGAACAGTCTGTGTTTATGCCCAGGTTCCTAGCACAATTGTTGATAGTACCCACCCCCTTTCAATCTCAACTGTCTGGATTTGAAGAACAAATTATGTGTCAATGTTGACATGGTAAACCTGAGACGGGAGAGATAGGCAGCCTGTGGGCCTCACTTTTGTACTTAACATTCTGGCCCCTCTTTAGTCTTGACCCTTGACCTCTAGC |
| 2687 | KRT8 | 3455589 | CAGAAGACGGCTCGAAGCAACATGGACAAC |
| 2688 | KRT8 | 3455590 | CTGGAGACCTTACTGCTTGAGGAGTGAATTAAGAGAAAAGACTGCTTGCTTTCCTCCAGACTTTGAGCCCTGGCCTGATGTAGACCTTTTTGC |
| 2689 | KRT8 | 3455591 | GCGGCCCCGAGGATTGGGCCCTTCACGCTGACTG |
| 2690 | KRT8 | 3455593 | AGCAACTTTCGCGGTGGCCTGGGCGGC |

TABLE 13-continued

Subtyping Target Sequences

| SEQ ID NO. | Gene | Affy Probeset ID | Sequence |
|---|---|---|---|
| 2691 | KRT8 | 3455594 | GATCTCCGCCTGGTTCGGCCCGCCTGCCTCC |
| 2692 | KRT8 | 3455596 | GGATCTGGCTGTCATCTGTTGGTCCTCTGAGTTCAGTTTCATCCAGTCCCCACATCACACCCTG CAGTATCTTCCAGAGA |
| 2693 | KRT8 | 3455597 | TAAGTTTGTCTGTCCTCCAAGGAGGGGGCTTCTGGGTCTCTCTGTCCTTCTGGGTAGGGGTCC TATGTGCCTGTCTTTCTGTGAGCCTGGGTGTCTCTCCTAGAGAAGGATGGGGAAGAAACTGTA CATCTGTCCTCCCAGTAGGTGGTCACCCCCTTCCCTGGGTCAGGGCTATGTCACCTGTC |
| 2694 | KRT8 | 3455607 | AGGAGGTGCTGGCGAGTTTGAAATTTGG |
| 2695 | KRT8 | 3455608 | AGCGCCTGCATAGACGCTGGCCGCGCTGCTGACCGGCCGGGCGCCGTA |
| 2696 | KRT8 | 3455609 | CTGGGGTCCCTTCTTCTCCAAGTGCTCCCGGATTTTGCTCTCCAGCCTCCGGTTCTCGGTCTCC AGGCTCCTCAC |
| 2697 | KRT8 | 3455610 | TAGGGGTTGGGTGGTTATGGAATGACGGAAAGAGGCAAAGGAGTGTATAATTGGAGGGTCA GACAAGGCTGGGA |
| 2698 | KRT8 | 3455611 | CCTCTGTAAAGCTCTCAACCCTGTCCCCTTCCCCCTCTCTCCTGGGAAAGAGCCCTCCCATGCCT AGCTGCTGCTCTTAGGGACCCTGTGGCTAGGTGCGCGGATGGAAATCCAG |
| 2699 | LUM | 3465249 | TGGTACAGCGGCCTTTCATCAGAGGATCATCATTGAGACTGAGTTGACTGGCAGATATGTGC GATGGATATTACATTAGGTACAATGTGTATTTTTGATTTTCATGAGTTTTCTACATTAAGGTAA ATTCCTTAGAGTGTGATAGCAGCCTCAGTTTA |
| 2700 | LUM | 3465250 | GAAATCAAAAGATATCTCTGGCCTGCAATATTTTACTGATGTGAACATAGGATTTTCCACTAAA TAATTTGTCTACTTCTAGCATTCACTTACAAAGAGTTCTTAAAAACACCTATAATAGGTACTTA GATTTCACAACTTACTTAGATATTTGTCATTATTCCCATTCCTGGTGTTTTTACTGGTTCATATA CAATGGTATTCTATTAGATAAGAAGCTGCTATGTGATCTCAGCACTCACTCCTTGGTTGTCAAG AAATGGTGGATAACTCACAGGATTAAAAATGAATGAATATAAAATTTTCTGAAATAGATATTT AAAAAATCATTTTAGCTTGAAGCCAATATGTCTGGATCATAGGTTTTGAGTTCATAATCCAGTA ATAACAGCTTTCAGCTTTCTATGAGTATATACAATTCTATACAATGATAAATACTCTGCATATA ATTTATAAAAATAACTTCTGTTTTACCTAGTTAACAATAAAACCTATGTGTGGAGCCAAATGTT ATGCAGACAAAGGTCTGCTCATCCCATACCAGTG |
| 2701 | LUM | 3465251 | ACCTTTTACTGGTTGCATGGAAATCAGCCAAGTTTTATAATCCTTAAATCTTAATGTTCCTCAAA GCTTGGATTAAATACATATGGATGTTACTCTCTTGCACCAAATTATCTTGATACATTCAAATTT GTCTGGTTAAAAAATAGGTGGTAGATATTGAGGCCAAGAATATTGCAAATACATGAAGCTT CATGCACTTAAAGAAGTATTTTTAGAATAAGAATTTGCATACTTACCTAGTGAAACTTTTC |
| 2702 | LUM | 3465252 | GTGTCAGTTTTCATAGTATCCATATTTTATTACTGTTTATTACTTCCATGAATTTTAAAATCTGA GGGAAATGTTTTGTAAACATTTATTTTTTTAAAGAAAAGATGAAAGGCAGGCCTATTTCATC ACA |
| 2703 | LUM | 3465253 | ATGAATGTCTACGTGTTGCTAACGAAGTCACTCTTAATTAA |
| 2704 | LUM | 3465254 | AGATCCTGGGGCCATTATCCTACTCCAAGATCAAGCATTTGCGTTTGGATGGCAATCGCATCT CAGAAACC |
| 2705 | LUM | 3465257 | CCTGACAGAGTCTGTGGGCCCACTTCCCAAATCTCTGGAGGATCTGCAGCTTACTCATAACAA GATCACAAAGCTGGGCTCTTTTGAAGGATTGGTAAACCTGACCTTCATCCATCTCCAGCACAA TCGGCTGAAAGAGGATGCTGTTTCAGCTGCTTTTAAAGGTCTTAAATCACTCGAATACCTTGA CTTGAGCTTCAATCAGATAGCCAGACTGCCTTCTGGTCTCCCTGTCTCTCTTCTAACTCTCTACT TAGACAACAATAAGATCAGCAACATCCCTGATGAGTATTTCAAGCGTTTTAATGCATTGCAGT ATCTGCGTTTATCTCACAACGAACTGGCTGATAGTGGAATACCTGGAAATTCTTTCAATGTGTC ATCCCTGGTTGAGCTGGATCTG |
| 2706 | LUM | 3465258 | TGATTGGTGGTACCAGTGGCCAGTACTATGATTATGATTTTCCCCTATCAATTTATGGGCAATC ATCACCAAACTGTGCACCAGAATGTAACTGCCCTGAAAGCTACCCAAGTGCCATGTACTGTGA TGAGCTGAAATTGAAAAGTGTACCAATGGTGCCTCCTGGAATCAAGTATCTTTACCTTAGGAA TAACCAGATTG |
| 2707 | LUM | 3465259 | GTGCATCTGCTTTAAGAATTAACGAAAGCAGTGTCAAG |
| 2708 | LUM | 3465260 | TGGCAGCCAGTTCCGTCCTGACAGAGTTCACAGCATATATTGGTGG |
| 2709 | LUM | 3465261 | GCCACAGATGTAAAGAGGCTTGTAAGAAAAATGTTCTCACAGTGAGCTTCCTTATTTGAAGCA GGACTCAATTCTTGGTTAAAAGCTATGGTATTTGAGCTAGTTAAACACATATCTCTCTCCCATT CCATAGGGAATGAGCTGGGCTGTCCTTTCTCCCCACGTTCACCTGCACTTCGTTAGAGAGCAG TGTTCACATGCCACACCACAAGATCCCCACAATGACATAACTCCATTCAGAGACTGGCGTG |
| 2710 | DCN | 3465265 | CAACTTCCATATGGAGGTGTCAAGGAGGATTTAGATCTAGAATTTTGGAGCTCAAGGGAAAG GGTTGAGCTGTAGACATAAATTCTAGAGATGCCGGAATATAGATTGTGATCCTTCTTTATCAG |

TABLE 13-continued

Subtyping Target Sequences

| SEQ ID NO. | Gene | Affy Probeset ID | Sequence |
|---|---|---|---|
| | | | CACAGAAATGACTTGACTTTGTCCAAACTAAGCAATCATACTGTACATGTTAGCAACACATTTT<br>ACAGGGCCAATTTG |
| 2711 | DCN | 3465267 | ACTGTGAGGGCTGAATGAATGCTTCCAGGCCATCAGGAACAAGCATAGAAACACAAATCAAT<br>TTTAAAATACACTCAAAAATGTCAAAATAATCCAACTTTTTTGTCTTGATCAGATATATCTACTA<br>GCACATATTACTTCATTTTTTCAGCCAATATTTATTAATAACCTACTGTGTGCTTGACAGTGTTC<br>TAGTGGCAGAGACACAGCAGTGCATAATGCCTTGCCCTCTGAAGCAGATGTTGCAGCAGGAG<br>GAGACATTCCAGGACATGACA |
| 2712 | DCN | 3465269 | GGTGTTGCTACTGCCATTGTTATTACAGGCACACAGTTCGAGCTATAATCATTTCAAGGGAAA<br>TTCTTATGTGTCAGTTCTGGATCGAGGTCTGAGATTCTGCATTTCAAACAAACTTCCAGGAATG<br>CTGCTGCTTCTTGGTCCACACTTGGAGAAATAAGTCAGCAGAGAGTCCTCTCGTTTCCTATTGT<br>ACCATGTCTGTCTTTTGTCTCCTGCTTATTGGCCTCTGTAAGG |
| 2713 | DCN | 3465271 | AGCCTTCAATGATGCACACTCCATGTTATAGCCTTGAATGATATACCCTTTATGCTGCAGCCTT<br>TCTCTTATGGGAAAAGCCTGCAGATATCCTGCTGCTTAACTGACAAGTGTGGTGAGAAATAA<br>GTAGAAATCTAAAGAGGGGAAGACCATTTTGGACACTTATCTGCAAGGCAGATCCAACACAC<br>TTTTCCAGTAGTCAAGCTACTTCTAATTTTGTTCAGTATCAAAATGAGAAACAGGCCTGATTCT<br>CCAGCACTCTTGTC |
| 2714 | DCN | 3465273 | ATGAGTGCAGTGGAACATGAAAAACTTGAGGAGATAACAGTTGAG |
| 2715 | DCN | 3465275 | TTCATGTAATCAGGCTGAACATTTCTACAATTACTAGATGTATTAGACGTAAGTATTTTCTTTA<br>GTTAAACCACCCATGTTAGAAATGTTTTCTGTAGAATTTATAAACAACTATCAATGCAGACAAT<br>TTAATAAGCCTGGGGATGATTTACTTACAGTAAACATTTATCAAATTGTACATTTGTGCTATCA<br>ACAATT |
| 2716 | DCN | 3465276 | CCTCTCCCTATCTTACATTTGAGTATGGTAACTTATGTCATCTATGTTGAATGTAAGCTTATAAA<br>GCACAAAGCATACATTTCCTGACTGGTCTAGAGAACTGATGTTTCAATTTACCC |
| 2717 | DCN | 3465277 | TACAGGCTATGTAAAATTTTTACTAATGTCATTA |
| 2718 | DCN | 3465278 | CAGTTAGCTCATTTGAGATAAAGTCAAATGCCAAACACTAGCTCTGTATTAATCCCCATCATTA<br>CTGGTAAAGCCTCATTTGAATGTGTGAATTCA |
| 2719 | DCN | 3465279 | TCTGTTGATGTTAACTGAGCTACTAGAGATATT |
| 2720 | DCN | 3465280 | CATAAAGCCAAATTTCCAGTTTAAG |
| 2721 | DCN | 3465281 | CTGCAATGTGGATGTTTTACCCACATGAC |
| 2722 | DCN | 3465282 | TATAACCTGGCAAAATCTTGTTAATG |
| 2723 | DCN | 3465283 | GTGCGCTCTGCCATTCAACTCGGAAACTATA |
| 2724 | DCN | 3465284 | TCTCTGTAGTTGGATCAAGTGACTTCTGCCCACCTGGACACAACACCAAAAAGGCTTCTTATTC<br>GGGTGTGAGTCTTTTCAGCAACCCGGTCCAGTACTGGGAGATACAGCCATCCACCTTCAG |
| 2725 | DCN | 3465286 | GCTTCTTTGGTCTAGCTCCTGATTCTTTTTGACATGGCCTCATCATTTTTCTTTATTTCCTCTAAA<br>AAAAAAATGAGATACGTTTGCAGAATGTGCAGGTTTGTTATATAGGTATACGTGTGCCATGGT<br>GGTTTGCTGGCCCTACTGACCCATCCTCTAAGTTCGCCCGCTCACCCCCTACCCCCTGTTGTGT<br>GTTTTGTTACCCTCTCTGTG |
| 2726 | DCN | 3465287 | CCACTGCTTATGTGAGGAATATCCAAA |
| 2727 | DCN | 3465288 | CTGCTGTTGACAATGGCTCTCTGGCCAACACGCCTCATCTGAGGGAGCTTCACTTGGACAACA<br>ACAAGCTTACCAGAGTACCTGGTGGGCTGGCAGAGCATAA |
| 2728 | DCN | 3465290 | CCTTCCCTTACGGAATTACATCTTGATGGCAACAAAATCAGCAGAGTTGATGCAGCTAGCCTG<br>AAAGGACTGAATAATTTGGC |
| 2729 | DCN | 3465293 | CCTGGAGCATTTACACCTTTGGTGAAGTTGGAACGACTTTATCTGTCCAAGAATCAGCTGAAG<br>GAATTGCCAGAAAAAATGCCCAAAACTCTTCAGGAGCTGCGTGCCCATGAGAATGAGATC |
| 2730 | DCN | 3465295 | GACAAAGTGCCAAAGGATCTTCCCCCTGACACAACTCTGCTAGACCTGCAAAACAACAAAATA<br>ACCGAAATCAAAGATGGAGACTTTAAGAACCTGAAGAAC |
| 2731 | DCN | 3465297 | GCGCCCGGCCTCAATATGTCTTCTAATCTTAAAGATAAAGAAGAGGAACCAGAATTGAAATTC<br>ACATAACAGTCTTATAAAAAAATGTTATTATAGGAGCATGTTTAAATATGA |
| 2732 | DCN | 3465299 | ATGCATGGCTTGGTTCTTGAATTAATGCTTGGATGAATATTCTACAATATTCTTGACTCTAGCA<br>AGCTGCAAAGAGAAGGGAACATGCCTGATTGAGAAACAAAAGTGATTTCTCAGTGCATCCTT<br>GCTCCTTCCCTTTAAGGACAACTGTAAAACCAGGAAGCTTAGAAATTCCTTGAGTTTGACTGG<br>AAAGAGAATAGAATTAAAGAGAAGAATCATCTATGTATGAAGCCTGGTCTAACTGATAACGC |

TABLE 13-continued

Subtyping Target Sequences

| SEQ ID NO. | Gene | Affy Probeset ID | Sequence |
|---|---|---|---|
| | | | AGTCAGATTGCCATTTTTAAGATGGAAAAAGGGGAACATGCTTGCCTTGAGCAGAAAAGTTT<br>TTGGTGGGGCTGGAGCTCCTAAATATTATTTTGGTCATTTGCCCAAAAACTGAAGTACACCAC<br>CAATGTCCCAATTATGAAGTTGAATACAGAATTATAAAAAAAAATTGTTGAAAGTCAATAAGA<br>ATAAATCTTAGAATTTGGACTCCTGCCACATGGCAGAAAAAAAGCATGATGTTTTAAGACAAC<br>CTGGCCTTTGTCCAACATG |
| 2733 | DCN | 3465302 | TCTGCAGGATAATTTGATGCCTCTGGAAAAATGCATGGACTGTTTTAGTCCCTAATTCTAATTT<br>ATCACAGTAGTATTAACACGTGCTTTTTTTTTTTTTAAGAGGATGAGGGATTGAGACAGTAA<br>ACATGAATTCCTCATAGATATTGGCCAAGTTGTTTCATTGAACTTGTTGCAACTTACCTTGTAA<br>TTGGAACCACAATTTTATGAGACCCATATCTTGTCTTCTTTTATCTATCATGTTAAGAAATAAAC<br>CAGTTCCCTCTTAATTATAGCA |
| 2734 | DCN | 3465303 | TCCTATTAATCGTGTGAGGTACCTGGGTCATAGTAGCAGCTTCATGCAGTGTTAAAATTATAT<br>GATGATTATATGCAGTAACAGATGAAGAAAAAAGAAAGAAAGCAGGAGAAATGCACCACC<br>TCATTCATTGTAAATGCAGTATAGTTGATTTTTTAATTTGTTTTATGTCCTCTAGTGATCTAAGC<br>ATGAAGCTTGAATTATTATAATAAAGAAAATAAATGCAATGCAGTTGGGGATGGCAAATGTT<br>AATGCTTATCTGTATCAAAGACTAACACTGTCTTCAGGATTATCCTTGGTGGATTATCCTTGGC<br>AGACACTTA |
| 2735 | DCN | 3465304 | TGTAGTCTTAGGAAGCAGCAAGTTCACTGACTTGGGATCTTTATGACAGTTTTGTTGTTGCCAT<br>TGATATTGTTTTGTTTATTTTTGTTTTCAGATGAGAAAGTTTTCTACATGTTATCTTTTTTCTAG<br>GAGCTCAAAGTGTACATCATTCCTTTATTATAGCTAGGTTTACTGACTCATATACTAAGGAAGT<br>AGCTAAAATTATAAAAATAATTTGTTTTTAAAACCATATTTAACTAAGGGAACTAAGTAAGTTC<br>CAATGAGCAGTGGTCTCATGCAAGGTATTTTCAATATTTTAAAATTTACAGATGAATATTTAAA<br>TATATTATAAAAGTTTTAATCAGCTATCTCTAAGAAAATACATTTCTTAAAGGGAAATGAAATT<br>CACTTGACTTTAAATAAAACAAATGAACTCATTTCATGTTTTTAACTATTATCTAACTCTTCCTT<br>ACTTTATGATGCTGGCAAGCTGTTGAGAGCCTTGACATC |
| 2736 | DCN | 3465305 | TGATTCCGCCATGTGTACTTCCTTCTGGAAGAAATTCCATACTATGATCAGGCACTTCTTTCAG<br>AAGTCCTATATTTACTCAGAACATGCTTTCTAGCAGTAGTTTGCAGAAGAAAAATGCAACTTCT<br>ACAATTGGAATAAACTGCCTATAGGAACCCAGAAAAAATATAAAGTATATTCAGTAGTAACG<br>ACTGAAAAACACTTGAAATAGCTTCTTCAACACATATATTGTATAGCTATTTAAAACCCAAATA<br>CAAATGTTATATGAAGACTTTCAAAAGGCCGCAGGATAATTCCAATGGATCTATTTGTTCAGT<br>CATTCAGAAGCTATATCGGGAACCCATCATGGATGAGCTCTGCTCTAGGCATGGGGAGAAAG<br>GATGAGGAAGACAAATATGGCCCTAGTTCTTGTGGATCTTATGTTCTAGTGGTGGTGACTATT<br>ACTTTTTGAATTGTGTATTTGCCACAGGGGAGATTGGATTACTC |
| 2737 | DCN | 3465306 | CCAGAAAGATTGAAGCTCAGTGGATGGG |
| 2738 | DCN | 3465307 | TTCCTGGGCTGGACCGTTTCAACAGAGAGGCTTATTTGACTTTATGCTAGAAGATGAGGCTTC<br>TGGGATAGGCCCAGAAGTTCCTGATGACCGCGACTTCGAGCCCTCCCTAGGCCCAGTGTGCC<br>CCTTCCGCTGTCAATGCCATCTTCGAGTGGTCCAGTGTTCTGATTTG |
| 2739 | DCN | 3465308 | ATCATCCTCCTTCTGCTTGCACAAG |
| 2740 | DCN | 3465310 | GGAGTACATCGTCTAGTGAGGGACAGACCAAGCACGCAAAACAAATTGCAATATAATGTGAT<br>AAGTTCTTTAAAAGAGGTAAGAGCAACGTGCTTTGGGAGCAGAGAAGAGGGAGAAAGCAGC<br>ATCTTGCCTGGATGAGCCAGG |
| 2741 | DCN | 3465311 | GATAATGACTCAAAACAGCTGTAAGATTCTACTTACGAACGTACAGCTTTAATATGGATTCGT<br>CTAAG |
| 2742 | DCN | 3465312 | CTTCTCTAGAGAATCTAGGCAAAAATTCCCAGAAGATAC |
| 2743 | DCN | 3465314 | ATCTAATGTGGGTGTCAGCCGGATTGTGTTCATTGAGGGAAACCTTATTTTTAACTGTGCTAT<br>GGAGTAGAAGCAGGAGGTTTTCAACCTAGTCACAGAGCAGCACCTACCCCCTCCTCCTTTCCA<br>CACCTGCAAACTCTTTTACTTGGGCTGA |
| 2744 | TBX3 | 3472758 | CAGAGGCTGCGTTTGACTTTTTAATTTTTCTTTTGTTATTTGTATTTGCTAGTCTCTGATTTCCT<br>CAAAACGAAGTGGAATTTACTACTGTTGTCAGTATCGGTGTTTTGAATTGGTGCCTGCCTATA<br>GAGATATATTC |
| 2745 | TBX3 | 3472759 | GCTGCCGTGCACTTTGTCGGATATAAAATAAACCACGGGCCCGCCATGGCGTTAGCCCTTCCT<br>TTTGCAGTTGCGTCTGGGAAGGGGCCCCGGACTCCCTCGAGAGAATGTGCTAGAGACAGCCC<br>CTGTCTTCTTGGCGTGGTTTATATGTCCGGGATCTGGATCAGATTCTGGGGGCTCAGAAACGT<br>CGGTTGCATTGAGCTACTGGGGGTAGGAGTTCCAACATTTATGTCCAGAGCAACTTCCAGCAA<br>GGCTGGTCTGGGTCTCTGCCCACCAGGCGGGGAGGTGTTCAAAGACATCTCCCTCAGTGCGG<br>ATTTATATATATATTTTTCCTTCACTGTGTCAAGTGGAAACAAAAACAAAATCTTTCAAAAAAA<br>AATCGGAACAAGTGAACACATTAACATGATTCTGTTTGTGCAGATTAAAAACTTTATAGGGA<br>CTTGCATTATCCGGTTCTCAATAAATTACTGAGCAGCTTTGTTTGGGGAGGGAAGTCCCTACCA<br>TCCTTGTTTAGTCTATATTAAGAAAATCTGTGTCTTTTTAATATTCTTGTGATGTTTTCAGAGCC<br>GCTGTAGGTCTCTTCTTGCATGTCCACAGT |
| 2746 | TBX3 | 3472760 | TTGGTTAGCGGCTTGGAAGCCAAGCCGGACAGGTCCCGCAGCGCGTCCCCGTA |

TABLE 13-continued

Subtyping Target Sequences

| SEQ ID NO. | Gene | Affy Probeset ID | Sequence |
|---|---|---|---|
| 2747 | TBX3 | 3472761 | GGACTCGGGCTCTGAACTCAACAGCCGCTCCTCCACGCTCTCCTCCAGCTCCATGTCCTTGTCG CCCAAACTCTGCGCGGAGAAAGAGGCGGCCACCAGCGAACTGCAGAGCATC |
| 2748 | TBX3 | 3472762 | GGCCCCTGGACGGCAAAGTCGCCGCCCTG |
| 2749 | TBX3 | 3472763 | CCTTCCTCAATCTGAACACCATGCGCCCGCGGCTGCGCTACAGCCCCTACTCCATCCCGGTGCC GGTCCCGGACGGCAGCAGTCTGCTCACCA |
| 2750 | TBX3 | 3472764 | CCTTACCCCTACACGTACATGGCCGCAGCGGCG |
| 2751 | TBX3 | 3472767 | GCCTGGCGGGCCAACAGTTCTTCAACGGGCACCCGCTCTTCCTGCACCCCAGCCAGTTTGCCA TGGGGGGCGCCTTCTCCAGCATGGCGGCCGCTGGCATGGGTCCCCTCCTGGCCACGGTTTCT GGGGCCTCCACCGGTGTCTCGGGCCTGGATTCCACGGCCATGGC |
| 2752 | TBX3 | 3472768 | GAGCCCTGCCGTGACAAGGGCAGCCCCGCGGTCAAGGCTCACCTTTTCGCTGCTGAGCGGCC CCGGGACAGCGGGCGGCTGGACAAAGCGTCGCCCGACTCACGCCATAGCCCCGCCACCATCT CGTCCAGCACTCGCGGCCTGGGCGCGGAGGAGCGCAGGAGCCCGGTTCGCGAGGGCACAGC GCCGGCCAAGGTGGAAGAGGCGCGCGCGCTCCCGGGCAAGGAGGCCTTCGCGCCGCTCACG GTGCAGACGGA |
| 2753 | TBX3 | 3472771 | AATGGGACCTCTGATGAGTCCTCCAGTGAACAAGCAGCTTTCAACTGCTTCGCCCAGGCTTCT TCTCCAGCCGCCTCCACTGTAGGGACATCGA |
| 2754 | TBX3 | 3472772 | TGCAAAAGGTTTCCGGGACACTGGAAATGGCCGAAGAGAAAAAAG |
| 2755 | TBX3 | 3472773 | GACATCTTGAAACTCCCTTATAGTACATTTCGGACATACTTGTTCCCCGAAACTGAATTCATCG CTGTGACTGCATACCAGAATGA |
| 2756 | TBX3 | 3472774 | CTAGGGTTCAAGGTATGAATGATCCTTAGATGGTGAGGGTGGGGGGGCCCTTTGGCAACT GAGGAGCAATTTGGATTCTCCAGAAGATAACATCTGTGGAGCGAAACGTACCCAGGGGGTAC TCCAAGGAGGTGGGCTCGGTACAAGCGTGGTACCCTGCGGTGGGGAAGATTTCAGCCTGGC AGGGGTCCTAAGATCCCGTTTGTTCTGCTAAATCCTTG |
| 2757 | TBX3 | 3472775 | CTTTGGCCTTCCCAAGTGATCACGCTACGTGGCAGGGGAATTA |
| 2758 | TBX3 | 3472776 | CCAAATAATGGAAGGCCTGGCGTTCTAAAAGAAATGGGGCAAGAAAACTTACCGGCTTGTGT TCTATAGCAATTCCAGCTCTTTGGTAGATTCCTGACCTGAGAGTGAAGTTAAAAACCATTTTTT AAGAGCTAAAATCAATTTCAAGGCTATGTATTCCTAAAGGATTTGTTTTGTTTTAAAATATCAT ACTTCTGTTTTGAAACCAGTGATATTATTTTCTCAGGAGAGTTTACGTTTCGGAGCCTTGACTC TGTTGGTTAAATGGTGTGAATACATTTTTAAAAACTCGTTCTTTTACTAAAAAAAGAATTGGGC TTAGGTGGGAGTCCGGCTTACCCTAAATGA |
| 2759 | TBX3 | 3472777 | ATGTTCTGGGCTGGATAAAAAAGCCAAATACATTTTATTGATGGACATTATAGCTGCTGATGA CTGTCGTTATAAATTTCACAATTCTCGGTGGATGGTGGCTGGTAAGGCCGACCCCGAAATGCC AAAGAGGATGTACATTCACCCGGACAGCCCCGCTACTGGGGAACAGTGGATGT |
| 2760 | TBX3 | 3472780 | AAAGAACTTTGGGATCAGTTTCACAAGCGGGGCACCGAGATGGTCATTACCAAGTCGGGAAG |
| 2761 | TBX3 | 3472781 | GGCCGAGACCGGCATCCCGTTCTCCTCCCTGGGG |
| 2762 | TBX3 | 3472782 | ATGGCCTACCATCCGTTCCTACCTCACCGGGCGCCGGACTTCGCCATGAGCGCGGTGCTGGGT CACCAGCCGCCGTTCTTCCCCGCGCTGACGCTGCCTCCCAACGGCGCGGCGGCGCTCTCGCTG CCGGGCGCCCTGGCCAAGCCGATCATGGAT |
| 2763 | TBX3 | 3472783 | AGCCTCTCCATGAGAGATCCGGTCATTCCTGGGACAAGC |
| 2764 | OLFM4 | 3490901 | AAGCTGCAGGGGATTTGGGGGATGTGGGACCTCCAATTCCCAGCCC |
| 2765 | OLFM4 | 3490902 | CAGCTCCAGGTCGGGCTCCAGCTCCAGCCGCAGCTTAGGCAGCGGAGGTT |
| 2766 | OLFM4 | 3490907 | TTTCCAATTTCACCGGCTCCGTGGATGACCGTGGGACCTGCCA |
| 2767 | OLFM4 | 3490908 | CACCTTTCCCGTGGACAGAGTGGAACGCTTGGAATTCACAGCTCATGTTCTTTC |
| 2768 | OLFM4 | 3490910 | GTGAGGGAATATGTCCAATTAATTAGTGTGTATGAAAAGAAACTGTTAAACCTAACTGTCCGA ATTGACATCATGGAGAAGGATACCATTTCTTACACTG |
| 2769 | OLFM4 | 3490911 | TGGAAAAACTGGTCATACAGCTGAAGGAGAGTTTTGGTGGAAGCTCAGAAATTGTTGACCAG CTGG |
| 2770 | OLFM4 | 3490912 | AAATATGACTCTCTTGGTAGAGAAGCTTGAGACACTAGACAAAAACAATGTCCTTGCCATTCGC CGAGAAATCGTGGCTCTGAAGACC |

TABLE 13-continued

Subtyping Target Sequences

| SEQ ID NO. | Gene | Affy Probeset ID | Sequence |
|---|---|---|---|
| 2771 | OLFM4 | 3490913 | GTGAGGCCTCTAAAGATCAAAACACCCCTGTCGTCCACC |
| 2772 | OLFM4 | 3490916 | ATCAGCAAACCGTCTGTGGTTCAGCTCAACTGGAGAGGGTTTTCTTATCTATATGGTGCTTGG GGTAGGGATTACTCTCCCCAGCATCCAAACAAAGGACTGTATTGGGTGGCGCCATTGAATAC AGATGGGAGACTGTTGGAGTATTATAGACTGTACAACACACTGGATGATTTGCTATTGTATAT AAATGCTCGAGAGTTGCGGATCACCTA |
| 2773 | OLFM4 | 3490917 | GTAGTGGTACAGCAGTTTACAACAACAAC |
| 2774 | OLFM4 | 3490918 | CACCGGGAATATTGCCAGAGTTAACCTGACCACCAACACGATTGCTGTGACTCAAACTCTCCC TAATGCTGCCTATAATAACCGCTTTTCATATGCTAATGTTGCTTGGCAAGATATTGACTTTGCT GTGGATGAGAATGGATTGTGGGTTATTTATTCAACTGAAGCCAGCACTGGTAACATGGTGAT TAGTAAACTCAATGACACCACACTTCAGGTGCTAAACACTTGGTATACCAAGCAGTATAAACC ATCTGCTTCTAACGCCTTCATGGTATGTGGGGTTCTGTATGCCACCCGTACTATG |
| 2775 | OLFM4 | 3490919 | TACCTTCTGAATTATGATCTTTCTGTCT |
| 2776 | OLFM4 | 3490920 | TGCAGGGGTGTCTAAAAGTGTGTTCATTTTGCAGCAATGTTTAGGTGCATAGTTCTACCACAC TAGAGATCTAGGACATTTGTCTTGATTTGGTGAGTTCTTGGGAATCATCTGCCTCTTCAGGC GCATTTTGCAATAAAGTCTGTCTAGGGTGGGATTGTCAGAGGTCTAGGGGCACTGTGGGCCT AGTGAAGCCTACTGTGAGGAGGCTTCACTAGAAGCCTTAAATTAGGAATTAAGGAACTTAAA ACTCAGTATGGCGTCTAGGGATTCTT |
| 2777 | OLFM4 | 3490921 | TTCTTTTCTCTCATTGTCCACCTTACTAAAAGTCAGTAGAATCTTCTACCTCATAACTTCCTTCCA AAGGCAGCTCAGAAGATTAGAACCAGACTTACTAACCAATTCCACCCCCCACCAACCCCCTTCT ACTGCCTACTTTAAAAAAATTAATAGTTTTCTATGGAACTGATCTAAGATTAGAAAAATTAATT TTCTTTAATTTCATTATGAACTTTTATTTACATGACTCTAAGACTATAAGAAAATCTGATGGCAG TGACAAAGTGCTAGCATTTATTGTTA |
| 2778 | OLFM4 | 3490922 | TCTAGGACGAGCTATAGAAAAGCTATTGAGAGTATCTAGTTAATCAGTGCAGTAGTTGGAAA CCTTGCTGGTGTATGTGATGTGCTTCTGTGCTTTTGAATGACTTTATCATCTAGTCTTTGTCTAT TTTTCCTTTGATGTTCAAGTCCTAGTCTATAGGATTGGCAGTTTAA |
| 2779 | GJB2 | 3504194 | TGCTTGTAACTAAAATAATTTTGTAATGTATCAAATACATTTAAAACATTA |
| 2780 | GJB2 | 3504195 | AGCAGATCTATAGGAAGATTGAACCTGAATATTGCCATTATGCTTGACATGGTTTCCAAAAAA TGGTACTCCACATATTTCAGTGAGGGTAAGTATTTTCCTGTTGTCAAGAATAGCATTGTA |
| 2781 | GJB2 | 3504196 | CGCATTGCCCAGTTGTTAGATTAAGAAATAGACAGCATGAGAGGGATGAGGCAACCCGTGCT CAGCTGTCAAGGCTCAGTCGCTAGCATTTCCCAACACAAAGATTCTGACCTTAAATGCAACCA TTTGAAACCCCTGTAGGCCTCAGGTGAAACTCCAGATGCCACAATGGAGCTCTGCTCCCCTAA AGCCTCAAAACAAAGGCCTAATTCTATGCCTGTCTTAATTTTCTTTCACTTAAGTTAGTTCCACT GAGACCCCAGGCTGTTAGGGGTTATTGGTGTAAGGTACTTTCATATTTTAAACAGAGGATATC GGCATTTGTTTCTTTCTCTGAGGACAAGAGAAAAAAGCCAGGTTCCACAGAGGACACAGAGA AGGTTTGGGTGTCCTCCTGGGGTTCTTTTTGCCAACTTTCCCCACGTTAAAGGTGAACATTGGT TCTTTCATTTGCTTTGGAAGTTTTAATCTCTAACAGTGGACAAAGTTACCAGTGCCTTAAACTCT GTTACACTTTTTGGAAGTGAAAACTTTGTAGTATGATAGGTTATTTTGATGTAAAGATGTTCTG GATACCATTATATGTTCCCCCTGTTTCAGAGGCTCAGATTGTAATATGTAAATGGTATGTCATT CGCTACTATGATTTAATTTGAAATATGGTCTTTTGGTTATGAATACTTTGCAGCACAGCTGAGA GGCTGTCTGTTGTATTCATTGTGGTCATAGCACCTAACAACATTGTAGCCTCAATCGAGTGAG ACAGACTAGAAGTTCCTAGTGATGGCTTATGATAGCAAATGGCCTCATGTCAAATATTTAGAT GTAATTTTGTGTAAGAAATACAGACTGGATGTACCACCAACTACTACCTGTAATGACAGGCCT GTCCAACACATCTCCCTTTTCCATGACTGTGGTAGCCAGCATCGGAAAGAACGC |
| 2782 | GJB2 | 3504197 | CTTCACAGTGTTCATGATTGCAGTGTCTGGAATTTGCATCCTGCTGAATGTCACTGAATTGTGT TATTTGCTAATTAGATATTGTTCTGGGAAGTCAAAAAAGCCA |
| 2783 | GJB2 | 3504198 | GCAGCTGATCTTCGTGTCCACGCCAGCGCTCCTAGTGGCCATGCACGTGGCCTACCGGAGAC ATGAGAAGAAGAGGAAGTTCATCAAGGGGGAGATAAAGAGTGAATTTAAGGACATCGAGG AGATCAAAACCCAGAAGGTCCGCATCGAAGGCTCCCTGTGGTGGACCTACACAAGCAGCATC TTCCTTCCGGGTCATCTTCGAAGCCGCCTTCATGTACGTCTTCTATGTCATGTACGACGGCTTCT CCATGCAGCGGC |
| 2784 | GJB2 | 3504199 | GATTGGGGCACGCTGCAGACGATCCTGGGGGGTGTGAACAAACACTCCA |
| 2785 | GJB2 | 3504200 | ATCCTATGACAAACTAAGTTGGTTCTGTCTTCACCTGTTTTGGTGAGGTTGTGTAAGAGTTGGT GTTTGCTCAGGAAGAGATTTAAGCATGCTTGCTTACCCAGACTCAGAGAAGTCTCCCTGTTCT GTCCTAGCTAGTGATTCCTGTGTTGTGTGCATTCGTCTTTTTCCA |
| 2786 | POSTN | 3510067 | ATTACTTCAAATTGAGTAATTCAGAAA |
| 2787 | POSTN | 3510068 | ATCGAAGAGTTGTGAACTGTTATCCCATTGAAAAGACCGAGCCTTGTATGTATGTTATGGATA CATAAAATGCACGCAAGCCATTATCTCTCCATGGGAAGCTAAGTTATAAAA |

TABLE 13-continued

Subtyping Target Sequences

| SEQ ID NO. | Gene | Affy Probeset ID | Sequence |
|---|---|---|---|
| 2788 | POSTN | 3510069 | ATGTTTATACAACCCTAAGTCAATAACCTGACCTTAGAAAATTGTGAGAGCCAAGTTGACTTC AGGAACTGAAACATCAGCACAAAGAAGCAATCATCAAATAATTCTGAACACAAATTTAATATT TTTTTTTCTGAATGAGAAACATGAGGGAAATTGTGGAGTTAGCCTCCTGTGGTAAAGGAATTG AAGAAAATATAACACCTTACACCCTTTTTCATCTTGACATTAAAAGTTCTGGCTAACTTTGG |
| 2789 | POSTN | 3510070 | TCTAGAAGACGATTAAGGGAAGGTCGTTCTCAGTGA |
| 2790 | POSTN | 3510072 | ACACACCCGTGAGGAAGTTGCAAGCCAACAAAAAAG |
| 2791 | POSTN | 3510073 | GTGGCTAACTCTGGGAAGATACTTGTGTTAAACTTTATATGACATTTAATAACCCTTCATCATA AGGCAATGTTTTTTACAAAAAGATTGAAAAAATCATGTAAGTCATTTACTCTGCAAAAATGGC ACATTAGGTGGGGTTCCAAAATCCATAATGAAACAATGTGTTTTGCAACTAAGAAACATTCAT TATGATATATGGAAAACACTGTCTGTCTACTTGTCCTTTACGAAAAAATGTAAAACTCTGAGG ATCATAAAATTTAACTACTAAAAATAATCTTCGTGTTTAAGTGATACTTATTTAAGACTTTACAC TGTTCTGTTTAACCATGGTCTCCTGTCTGATTTTAGCCATA |
| 2792 | POSTN | 3510074 | AAAACTGGACTTCATGCTGAGTATAGATGATACATATAAAAGAAGTCAAAATTTGGAGAAAA AATTTAAAAAGATAAGTAGAAAAATGAAGTAACTGTAGAAAACCATACTTACTCTTTGATCTCA AATGCCCAAAAACTGAATGAAAATGTGAATTTAGGCCGACCAGGTAGTCTTGTCAATA |
| 2793 | POSTN | 3510078 | TCTGTCTGTGGCATTAAATGAACCTTAAGAACA |
| 2794 | POSTN | 3510079 | CCCTTAACAGGTTCTAGTGACTGAGTTCAACTTTTTAAAGACTGAGCAAGCAGATTTTTTCTTT TAATTGGGTTAAAAAAAAAAAGACAACATCCACTGTTGTCTTAATAGATGGATTGGTTCAAT GGTAGTTAATAGTTATGAAGAAATGATTACTAGTTTAAACAGTCTTTAAAAAGTTCTATGGTA TAAAGTTTGGGGAGCAATGAATATTTTTTTGCTTTGATTCAGATAATTTTAAGGGCCTTTTAA GTATGCAAAGGGAAATAATTGTTAAATTGCTAGCTGTTAAACAAGCCCAAATTTGATATACT TTTTATATTTAAAAAATTATATTCACTGCCCCCATAAGAGCAATCAAGGCATGTCTTTAAATTC |
| 2795 | POSTN | 3510080 | ACCAAGGTCACCAAATTCATTGAAGGTGGTGATGGTCATTTATTTGAAGATG |
| 2796 | POSTN | 3510081 | AATACACTAGGATTTCTACTGGAGGTG |
| 2797 | POSTN | 3510082 | GAGACACGAGAAGAACGAATCATTACAG |
| 2798 | POSTN | 3510083 | GGGCCGACTACCTTCGCTGTGATTATTTTGAAATAGTGTTGGTTTAGAAATATTGAACATCTG ATATTTTCTCTTAGTTCTTATTTTATAAAAATTGTGGGAATTATTTCCTCAGCTATGAGTTCTTAT TAGCTGGTCAGAAATAAAACATAGTTAGCTTTTAATGGATCTAGTTGGAATTAATTTATCTATT AAGTCACTGGGCCCAACAAAATGTCATGATTTTTGCATATACAAGTGAGGATTGTGGAATAAA ATTGTAACATTAATGTCAGTATAAAAGGAAATATTAGAAACAGTAGGAAAAAATGACCATTGT ATAAGTCTCTGTCTAATAAGCCACTCCACTACTAGGATTTATGATAGGGCTCCCATTCCAATGA TATAGAACTCCCTGGATTCTCACTAAGTATTTATTCCACATCCAGAAAACAAGTATGACATGGA GAGTTAGGATGTCAAATGGCCCTCTCTC |
| 2799 | POSTN | 3510084 | AAGTCAAAATTGAAGGTGAACCTGAATTCAGACTGATTAAAGAAGGTGAAACAATAACTGAA GTGATCC |
| 2800 | POSTN | 3510085 | AAAGGACTGTTTTAACATGATAATTTGTCTCCTA |
| 2801 | POSTN | 3510089 | ATTAAAGTGATTGAAGGCAGTCTTCAGCCTATTATCAAAAC |
| 2802 | POSTN | 3510092 | TCAACTGCTGGAAATACTTAATAAAT |
| 2803 | POSTN | 3510093 | TGATACACTTCTGGTGAATGAATTGAAATCAAAAGAATCTGACATCATGACAACAAATGGTGT AATTCATGTTGTAGATAAACTCCTCTATCCAGCAG |
| 2804 | POSTN | 3510094 | CACCTGACACCAGGAGTTTTCATTGGAAAAGGATTTGAACCTGGTGTTACTAACAT |
| 2805 | POSTN | 3510095 | GCTCCTGACACAACCTGGAGACTGGACATTATTTGTGCCAACCAATGATGCTTTTAAGGGAAT GACTAGTGA |
| 2806 | POSTN | 3510096 | AGGGAGAAACGGTGCGATTCACATATTCCGCGAGATCATCAAGCCAGCAGAGAAATCCCTCC ATGAAAGTT |
| 2807 | POSTN | 3510097 | GATCAGCGCCTCCTTAAATTAATTCTGCAGAATCACATATTGAAAGTAAAAGTTGGCCTTAAT GAGCTTTACAACGGGCAAATACTGGAAACCATCGGAGGCAAACAGCTCAGAGTCTTCGTATA TCGTACA |
| 2808 | POSTN | 3510098 | CAAACAAGTTATTGAGCTGGCTGGAAAACAGCAAACCACCTTCACGGATCTTGTGGCCCAATT AGGCTTGGCATCTGCTCTGAGGCCAGATGGAGAATACACTTTGCTGGCACC |
| 2809 | POSTN | 3510099 | GTCTATTATGGGAGGAGCAGTCTTTGAGACGCTGGAAGGAAATACAATTGAGATAGGATGTG ACGGTGACAGTATAACAGTAAATGGAATCAAAATGGTGAACAAAAGGATATTGTGACAAAT AATGGTGTGATCCATTTGATTGATCAGGTCCTA |

TABLE 13-continued

Subtyping Target Sequences

| SEQ ID NO. | Gene | Affy Probeset ID | Sequence |
|---|---|---|---|
| 2810 | POSTN | 3510100 | AGCTGCCATCACATCGGACATATTGGAGGCCCTTGGAAGAGACGGTCACTTCACACTCTTTGC TCCCACCAATGAGGCTTTTGAGAAACTTCCACGAGGTGTCCTAGAAAGGATCATGGGAGACA AA |
| 2811 | POSTN | 3510101 | TTGTGCTCGAATCATCCATGGGAACCAGATTGCAACAAATGGTGTTGTCCATGTCATTGACCG TGTGCTTACACAAATTGGTACCTCAATT |
| 2812 | POSTN | 3510102 | GGAGAGCAACGTGAATGTTGAATTACTGAATGCTTTACATAGTCACATGATTAATAAGAGAAT GTTGACCAAGGACTTAAAAAATGGCATGATTATTCCTTCAATGTATAACAATTTGGGCTTTTC ATTAACCATTATCC |
| 2813 | POSTN | 3510103 | GTAATGAGGCTTGGGACAACTTGGA |
| 2814 | POSTN | 3510104 | CATGTTTATGGCACTCTGGGCATCGTGGGAGCCACCACAACGCAGCGCTATTCTGACGCCTCA AAACTGAGGGAGGAGATCGAGGGAAAGGGATCCTTCACTTACTTTGCACCGA |
| 2815 | POSTN | 3510109 | AAAGAAATACTTCAGCACTTGTAAGAACTGGTATAAAAAGTCCATCTGTGGACAG |
| 2816 | POSTN | 3510110 | CTATTGCTGCTTATTGTTAACCCTATAAACGCCAACAATCATTATGACAAGATCTTGGCTCATA GTCGTATCAGGGGTC |
| 2817 | POSTN | 3510111 | TTCTCTTCGGGGACTAACTGCAACGGAGAGACTCAA |
| 2818 | SLITRK6 | 3519841 | GTTGCAATTATATAGGCCATGGGTGGCTCAAAACTTTGAACATTTGAGCTTAAACAAATGCCA CTCTCATGCATTCTAAATTAAAAAGTTAAAATGATTAATAGTTCAGGTGGAAGAAATAAGCAT ACTTTTTGGGTTTTCTACACATTTTGTGTAGACAATTTTAATGTCAGTGCTGCTGTGAACTAAA GTATGTCATTTATGCTCAAAGTTTAATTCTTCTTCTTGGGATATTTTAAAAATGCTACTGAGATT CTGCTGTAAATATGACTAGAGAATATATTGGGTTTGCTTTATTTCATAGGCTTAATTCTTTGTA AATCTGAATGACCATAATAGAAATACATTTCTTGTGGCAAGTAATTCACAGTTGTAAAGTAAA TAGGAAAAATTATTTTATTTTTATTGATGTACATTGATAGATGCCATAAATCAGTAGCAAAAG GCACTTCTAAAGGTAAGTGGTTTAAGTTGCCTCAAGA |
| 2819 | SLITRK6 | 3519842 | AGTTTGAGGGCTTTCGCAGAAATGCTGTGATTCTGTTTTAAGTCCATACCTTGTAAATAAGTGC CTTACGTGAGTGTGTCATCAATCAGAACCTAAGCACAGCAGTAAACTATGGGGAAAAAAAA GAAGAAGAAAAAGAAACTCAGGGATCACTGGGAGAAGCCATGGCATTATCTTCAGGCAATTT AGTCTGTCCCAAATAAAATAAATCCTTGCATGTAAATCATTCAAGGATTATAGTAATATTTCAT ATACTGAAAAGTGTCTCATAGGAGTCCTCTTGC |
| 2820 | SLITRK6 | 3519843 | CCTTTGGTCCAAAGCATCTGGAAGAGGAAGAAGAGAGGAATGAGAAAGAAGGAAGTGATGC AAAACATCTCCAAAGAAGTCTTTTGGAACAGGAAAATCATTCACCACTCACAGGGTCAAATAT GAAATACAAAACCACGAACCAATCAACAGAATTTTTATCCTTCCAAGATGCCAGCTCATTGTAC AGAAACATTTTAGAAAAAGAAAGGGAACTTCAGCAACTGGGAATCACAGAATACCTAAGGAA AACATTGCTCAGCTCCAGCCTGATATGGAGGCACATTATCCTGGAGCCCACGAAGAGCTGA AGTTAATGGAAACATTAATGTACTCACGTCCAAGGAAGGTATTAGTGGAACAGACAAAAAAT GAGTATTTTGAACTTAAAGCTAATTTACATGCTGAACCTGACTATTTAGAAGTCCTGGAGC |
| 2821 | SLITRK6 | 3519844 | GGTTCTTGTTCTTCACCGCAGGAGAAGATACAAAAAGAAACAAGTAGATGAGCAAATGAGAG ACAACAGTCCTGTGCATCTTCAGTACAGCATGTATGGCCATAAAACCACTCATCACACTACTGA AAGACCCTCTGCCTCACTCTATGAACAGCACATGG |
| 2822 | SLITRK6 | 3519845 | AAAGGCATGTTCCTTGGTCTCCATAATCTTGAATACTTATATCTTGAATACAATGCCATTAAGG AAATACTGCCAGGAACCTTTAATCCAATGCCTAAACTTAAAGTCCTGTATTTAAATAACAACCT CCTCCAAGTTTTACCACCACATATTTTTTCAGGGGTTCCTCTAACTAAGGTAAATCTTAAAACA AACCAGTTTACCCATCTACCTGTAAGTAATATTTTGGATGATCTTGATTTGCTAACCCAGATTG ACCTTGAGGATAACCCCTGGGACTGCTCCTGTGACCTGGTTGGACTGCAGCAATGGATACAA AAGTTAAGCAAGAACACAGTGACAGATGACATCCTCTGCACTTCCCCCGGGCATCTCGACAAA AAGGAATTGAAAGCCCTAAATAGTGAAATTCTCTGTCCAGGTTTAGTAAATAACCCATCCATG CCAACACAGACTAGTTACCTTATGGTCACCACTCCTGCAACAACAACAAATACGGCTGATACT ATTTTACGATCTCTTACGGACGCTGTGCC |
| 2823 | SLITRK6 | 3519846 | TTCACTTTGGAAATGCTTCACTTGGGAAACAATCGTATTGAAGTTCTTGAAGAAGGATCGTTT ATGAACCTAACGAGATTACA |
| 2824 | SLITRK6 | 3519847 | GGCTGACGATGCTTCACACAAATGACTTTTCTGGGCTTACCAATGCTATTTCAATACACCTTG GATTTAACAATATTGCAGATATTGAGATAGGTGCATTTAATGGCCTTGGCCTCCTGAAACAAC TTCATATCAATCACAATTCTTTAGAAATTCTTAAAGAGGATACTTTCCATGGACTGGAAAACCT GGAATTCCTGCAAGCAGATAACAATTTTATCACAGTGATTGAACCAAGTGCCTTTAGCAAGCT CAACAGACTCAAAGTGTTAATTTTAAATGACAATGCTATTGAGAGTCTTCCTCCAAACATCTTC CGATTGTTCCTTTAACCCATCTAGATCTTCGTGGAAATCAATTACAAACATTGCCTTATGTTG GTTTTCTCGAACACATTGGCCGAATATTGGATCTTCAGTTGGAGGACAACAAATGGGCCTGCA ATTGTGACTTA |

TABLE 13-continued

Subtyping Target Sequences

| SEQ ID NO. | Gene | Affy Probeset ID | Sequence |
|---|---|---|---|
| 2825 | SLITRK6 | 3519848 | TGCTAATAAATTGTGAAGCAAAAGGTATCAAG |
| 2826 | SLITRK6 | 3519849 | AGGCTCTTGTGATTCTCTTTGCAATTGTGAGGAAAAAGATGGCACA |
| 2827 | SLITRK6 | 3519850 | AGCTGTGGATTCATCTCTTTTATTCATCTCTCCTTGCCTGTATATCTTTACACTCCCAAACTCCAGTGCTCTCATC |
| 2828 | SLITRK6 | 3519851 | ATAACGTCAGGAAGAGTCTCTGCTTTACAG |
| 2829 | SLITRK6 | 3519852 | GGAGAACATTGCTGTAGCTTGGATCTACAACCTAAGAAAGCAAGAGTGATCAATCTCAGCTCTGTTAAACATCTTGTTTACTTACTGCATTCAGCAGCTTGCAAATGGTTAACTATATGCAAAAAAGTCAGCATAGCTGTGAAGTATGCCGTGAATTTTAATTGAGGGAAAAAGGGACAATTGCTTCAGGATGCTCTAGTATGCACTCTGCTTGAAATATTTTCAATGAAATGCTCAGTATTCTATCTTTGACCAGAGGTTTTAACTTTATGAAGCTATGGGACTTGACAAAAAGTGATATTTGAGAAGAAAGTACGCAGTGGTTGGTGTTTTCTTTTTTTAATAAAGGAATTGAATTACTTTGAACACCTCTTCCAGCTGTGCATTACAG |
| 2830 | DHRS2 | 3529241 | CTGACAGAAGGGCTGCCAAACTGCACTCCAGACA |
| 2831 | DHRS2 | 3529244 | GCCTGATTCAGCAGGAAGCATCTCAGACACCAA |
| 2832 | DHRS2 | 3529245 | GCTACCAGGGCTGGTTTCATCCCTGTGCTAGGCTTTCTGTGAGGATGAGCAGCACCGGGATAGACAGGAAGGGCGTCCTGGCTAACCGGGTAGCCGTGGTCA |
| 2833 | DHRS2 | 3529246 | ATCGGCTTTGCCATCGCCCGACGTCTGGCCCGGGACGGGGCCCACGTGGTCATCAGCAGCCGGAAGCAGCAGAACGTGGACCGGGCCATGGCCAAGCTGCAGGGGGAGGGGCTGAGTGTGGCGGGCATTGTGTGCCACGTGGGGA |
| 2834 | DHRS2 | 3529247 | GTGTGCAGCGCAGGGGTCAACCCTCTGGTAGGGAGCACTCTGG |
| 2835 | DHRS2 | 3529248 | TCTCTCCTAGAAGGGGGCTCCTCACTGAGTCCCACACAAACTTGCCGACAGGACCAGATCCAGCCATCAGCATTCCGGGGGCTTAGACATCCCAGCCT |
| 2836 | DHRS2 | 3529249 | GTGCGCCCTCTTTCAGGCTCATGGATAGTTCTCTGCTCAGAACTACTTGGCACACTGAGCTACTCTCTCTTACTTTCTAATGGGGCAGTTTTCTTCATCAAGGGAGGGAGTCTCACCTTTTCTTTGGCTTGGTTTTTGTTCCTGAGTCCAGGAGGGGTCTTACCTCAGCCCCTCACTCAGCCTGATGCACATGGAGTATTGGACAGATATCCTGTGGGCTGGTGGGGTCTGTTTTGACCAGGAAACCCTTACAGCTAACCTAATCCTCAATTCCTTCTTATTAGGGACCTCAGGGTGGTACCCACTTCTGACATCTGGACCACTTCTTGCAGTCATTGGGGGTCATCCCCCACACTGGTAACCTGTCATCAAATGGGCCAGCAACATTCAGCTTAAGTATTTCTCCTTCCCACATCCAAGGGATTGAGTGGGAGTGAGATTGGGGGGTGGAAAAAACAGTGAACAGTCCTGGTGAGTTGCAGATGTGGTCTCATTCCCTAGAGATGCAGGATGCAGCTGACCTGAATCAGGACAGATCCCTGCAGGAGGGACTCCTGGTGCCATGTCAGTCCCACCTGGCACTGCCCTAGCTCCCAGGCTCCGCCTCTGCATCTTTCCTTGCTACTTCCTCTTTCACTTCTCCCCCGTTCCCAGACCCACCAGACAGAGCTTCCAGAGTGTCAGGACATGTGTGACTTAGCCCAGA |
| 2837 | DHRS2 | 3529250 | GCCAGTTGCTGCCCTACATGGAGAACAG |
| 2838 | DHRS2 | 3529251 | CTTGGCCTTGACATCAGCAGGTTTGGGACAAGGCTATGCTTTAACTCCTTGACCTTGTGGGCTGGTCATTGTCACCTTACCTGCTCTCTGTTCTTACCAACTTAAAACCAATGACAGGGTTAGCCCCATTCCTCTCCATAGGAAAAAGCCTGTCCCAGACCTCTCCTCATGCCTGCGCTTGGTCTCCAGGGACCCTGCCTGTGTTCCAGGTCCTGCAGATCTGACTGTACCCCTCACAGACACACCCTTAGGAACTGGCCAGGGGCTGTCTTCAGTAGAAGGAAAGTTCCTGACTGTCACTTCTGGTCTCCCTTACCCCATCTGCTCCTTAGAGGTTGCTCATTGATAGGCACTCACCATCAGCCTTGGGTGCCTCTTCACAAAGCCCACCCTGCCCTCTCCTTCAAGCACCTGGCAAGAGAGGAAGCAGAAGATAAGGGTTCTGAGCATGGACATCGTATTTATGAGAAATAGGCATGGAATCCTAGCTCTGCCGTGTATTGGCTGGTACTA |
| 2839 | DHRS2 | 3529252 | AGGGGTGCTGTCATCCTGGTCTCTTCCATTG |
| 2840 | DHRS2 | 3529253 | ATAGGGTGAGGGGCAACTTTGTTCTTTTCCTCAGAGCCTTACAGACAAAGTGCCTGGGACAGACCCCCACCATCCTCCTGCTGCCCTGGGCTGAGCTTGTCTCCATGTGGGTGGGAGGGCTGCTGGGCCTGTGAGATCCCTGTAGGTGAGAAATCC |
| 2841 | DHRS2 | 3529254 | GCGCTGGGTGTCTACAATGTCAGCAAGACAGCGCTGCTGGGTCTCACTAGAACACTGGCATTGG |
| 2842 | DHRS2 | 3529255 | GTAAACTGCGTGGTTCCAGGAATTATC |
| 2843 | DHRS2 | 3529256 | CTGAATCCTTAGGTCAGCATGCCTATGACTGAGGTCCTCATTGTTCTCTGAACTCAGCCATGGTGCAGTCCATCCATCCTGAAAAGATGCTCCTTCTTTTGAGAAGGGCAAAGCTGCCCTAGGTGTTCTGCCTGGTGGCCTTCCCGGGGCCCTGCCCATCTTGTTTTAGTAGCACTGAC |
| 2844 | DHRS2 | 3529257 | TCATGGGAATGAGTCTCTCTGGAAGAACTTCAAGGAACATCATCAGCTG |

TABLE 13-continued

Subtyping Target Sequences

| SEQ ID NO. | Gene | Affy Probeset ID | Sequence |
|---|---|---|---|
| 2845 | DHRS2 | 3529258 | GTTGAGTCTATTGCAAGAGCAGACCCCTCCCTGTCATCTGGCCATTGTTTTTGCTGAAATCTGG<br>AGTCCACATGGCCCTGGAGGGTGCAAGTAGCCCTGCTGCATCCACCTTGTTCCCCATGGAGCC<br>CACTCCCACCTGTCATCCGTGAGCCCCAGAGCAGCAGAATCAGAGTACAAG |
| 2846 | DHRS2 | 3529259 | GGACTGTGCAGGAATCGTGTCCTTCCTGTGCTCTCCAGATGCCAGCTACGTCAACGGGGAGA<br>ACATTGCG |
| 2847 | DHRS2 | 3529260 | GTGGCAGGCTACTCCACTCGGCTCTGA |
| 2848 | DHRS2 | 3529261 | GCGGCTGCGTAGCTGTGGTCCCAGGC |
| 2849 | DHRS2 | 3529262 | GCCATTCTGCCAGACTAGCAATTTGGGGGCTTACTCATGCTAGGCTTGAGGAAGAAGAAAAA<br>CGCTTCGGCATTCTCCTTAGGACTTATCTGCTTGTAGATTTGGCTGATCCA |
| 2850 | WARS | 3579547 | CTCCTGTCACCCAGTAGAGTAAATAAACT |
| 2851 | WARS | 3579548 | TGGTTGATGTATCTGGGTCTCCTCTG |
| 2852 | WARS | 3579549 | CCTGGCCTCTGTAAGCCTGTGTATGTTATCAATACTGTTTCTTCCTGTGAGTTCCATTATTTCTA<br>TCTCTTATGGGCAAAGCATTGTGGGTAATTGGTGCTGGCTAACATTGCATGGTCGGATAGAG<br>AAGTCCAGCTGTGAGTCTCTCCCCAAAGCAGCCCCACAGTGGAGCCTTTGGCTGGAAGTCCAT<br>GGGCCACCCTGTTCTTGTCCATGGAGGACTCCGAGGGTTCCAAGTATACTCTTAAGACCCACT<br>CTGTTTAAAATATATATTCTATGTATGCGTATATGGAATTGAAATGTCATTATTGTAACCTAG<br>AAAGTGCTTTGAAATATTGATGTGGGGAGGTTTATTGAGCACAAGATGTATTTCAGCCCATGC<br>CCCCTCCCAAAAAGAAATTGATAAGTAAAAGCTTCGTTATACATTTGACTAAGAAATCACCCA<br>GCTTTAAAGCTGCTTTTAACAATGAAGATTGAACAGAGTTCAGCAATTTTGATTAAATTAAGA<br>CTTGGGGGTGAAACTTTCCAGTTTACTGAACTCCAGACCATGCATGTAGTCCACTCCAGAAAT<br>CATGCTCGCTTCCCTTGGCACACCAGTGTTCTCCTGCCAAATGACCCTAGCCCTCTGTCCTGC<br>AGAGTCAGGGTGGCTTTTCCCCTGACTGTGTCCGATGCCAAGGAGTCCTGGCCTCCGCAGAT<br>GCTTCATTTTGACCCTTGGCTGCAGTGGAAGTCAGCACAGAGCAGTGCCCTGGCTGTGTCCCT<br>GGACGGGTGGACTTAGCTAGGGAGAAAGTCGAGGCAGCAGCCCTCGAGGCCCTCACAGATG<br>TCTAGGCAGGCCTCA |
| 2853 | WARS | 3579550 | ATTACACCAGCGGAGCCATGCTCACCGGTGAGCTCAAGAAGGCACTCATAGAGGTTCTGCAG<br>CCCTTGATCGCAGAGCACCAGGCCCGGCGCAAGGAGGTCACGGATGAGATAGTGAAAGAGT<br>TCATGACTCCCCGGAAGCTGTCCTTCGACTTTCAGTA |
| 2854 | WARS | 3579552 | CAATAAGCATGCGTTTTCTGGAGGGAGAGACACCATCGAGGAGCACAGGCAGTTTGGGGGC<br>AACTGTGATGTGGACGTGTCTTTCATGTACCTGACCTTCTTCCTCGAGGACGACGACAAGCTC<br>GAGCAG |
| 2855 | WARS | 3579554 | AGCCAGCGGGATCAGAAACATGCCCTGGGGGGCACACGCACACACACCACTGCGCAGTG<br>CTTTGGGCCTCAGCCACCCAGCCACCGTAGCAATGCTGAACTCCAGGATTGCCAACTTTGCT<br>CCTGCAGAACTCAAGGCAGCCTGTCCTTCCCACATGAATCAGGTGAATTTGTTTTGTGTCCTTT<br>CATTTAGGTAAAATTTTGAATTTTTTTTCTTTTTTTCCTTTTCTGCTTTTCTTATCAGCACTGTTCT<br>GCAGGCAAAGTCA |
| 2856 | WARS | 3579555 | GATCGGCTATCCTAAACCAGCCCTGCTGCACTCCACCTTCTTCCCAGCCCTGCAGGGCGCCCA<br>GACCAAAATGAGTGCCAGCGACCCCAACTCCTCCATCTTCCTCACCGACACG |
| 2857 | WARS | 3579557 | CCCTCCTTCAGCAACTCATTCCCACAGATCTTCCGAGACAGGACGGATATCCA |
| 2858 | WARS | 3579559 | ATGAGCTCAGGTTTCTACAAAAATGTGGTGAAGATTCAAAAGCATGTTACCTTCAACCAAGTG<br>AAAGGCATTTTCGGCTTCACTGACAGCGACTGCATTG |
| 2859 | WARS | 3579560 | TCTTGCCAAGGATAGTCAGTCTTCCAGAGTTATGTCTTCCTCCTTTTCAACGCACCTTTTCCTCA<br>CAGAGAAAAGACTCAGTGGTTACACAGTTTCCTCAG |
| 2860 | WARS | 3579561 | CCAAGGACATCATCGCCTGTGGCTTTGACATCAACAAGACTTTCATATTCTCTGACCT |
| 2861 | WARS | 3579562 | GTGGCTCCAGGATGTATTTAACGTGCCCTTGGTCATCCAGATGACGGATGACGAGAAGTATCT<br>GTGGAA |
| 2862 | WARS | 3579563 | TGGGCTCACTTTAGAGGACCATGGAGTGATGGGAGAGCGCAGCTTTGGAGTCAGCCAGGC<br>CTGCTCCTCTTCTCATCCTGCTCCCTGTCTGCATGGCCATGGGCCTGCTACTTCTCTGAGCCTAA<br>GTTTCCACATCTGCAAGATGAGAATGAAGATACCTACCTCATAGAACTACTGTAAAGCTTCAA<br>AACAAAGTGTGTAGAGCAGCTAACACAGAGCACACAGGGCCACCTGGTCGATAAATGGTAGT<br>AGACCTTATCATTATCCATAGTCAAATTCATATCACAATTCAAATTGTGATTTTGTAGGCAAGG<br>AAGTTTTAACATACGTTGTAAGTAGGAGCTGTGTTTTCAGATGCACGATGGCGTTCCTCC |
| 2863 | WARS | 3579564 | ATCAGGTTCTTGATGCCTATGAAAATAAGAAGCCATTTTATCTGTACACGGGCCGGGCCCCT<br>CTTCTGAAGCAATGCATGTAGGTCACCTCATTCCATTTA |

TABLE 13-continued

Subtyping Target Sequences

| SEQ ID NO. | Gene | Affy Probeset ID | Sequence |
|---|---|---|---|
| 2864 | WARS | 3579568 | GCTAATAAACCGAATAGAGAGAGCCACCGGCCAAAGACCACACCACTTCCTGCGCAGAGGCA TCTTCT |
| 2865 | WARS | 3579569 | GGGAGGATTACAAGGCTGACTGTCCTCCAGGGAACCCAGCACCTACCAGTAATCATGGCCCA GATGCCACAGAAGCTGAAGAGGATTTTGTGGACCCATGGACAGTACAGACAAGCAGTGCAA AAGGCATAGACTACGATAAGCTCATTG |
| 2866 | WARS | 3579571 | TGAGTTCGAGCGATTCTCCTGCCCTGGCCT |
| 2867 | WARS | 3579576 | TAAGGTCCCTCAAAGCGGGAAATGCGTCAAAG |
| 2868 | WARS | 3579577 | ACAGTGAGCCCGCATCTCTGCTGGAGCTGTTCAACAGCATCGCCACACAAGGGGAGC |
| 2869 | WARS | 3579578 | GCCGGCTGTGAACGTAGTTCCTGAGAGATA |
| 2870 | WARS | 3579579 | GTCTGCTGAACAAATCCTCTGACCTCA |
| 2871 | WARS | 3579582 | GTGAATCTACTTCTCTTAACAAAGTCTCAATGTCCTATTTGCAATTTATGTGGTAAACACTGAA GACAATGGTCCTTAACCTTT |
| 2872 | WARS | 3579583 | AACTGCCCAGCGTGACCAGTGGCCACCTCTGCA |
| 2873 | WARS | 3579584 | GAAGAGTATTAAAGACCATTTCTGGC |
| 2874 | WARS | 3579585 | TTATAAGAAACCCTTAGCTGAATGC |
| 2875 | WARS | 3579586 | TGGCCCTCCCGGGAGTATCCTTAGAGCCCGGCTTGCTGCCCGCCGCGTTCTGGCACTGTGAG GCGCGGAGCCTGCCACCGACCCCTCGCCCCTTTCCTCTGAGCGCCGCCGACCCACCCCGTCTC CCTTTCCCACTGGCACCCTTCATCGTCTCCGCCTGTTCGCTTTTCCCGAGGAGAGAGGCCCCCA TTTTTATTTAGCGCCTGCCATGTGCCAGAGGCTTTGCGTAGTGTTGCACTTAGTCCCCTCAACG GTAATGTTAGCAGGCTTCTCCATGCCCATTCCACAGATGAGGAAACCGAAGGGGAAGCAGAA AAGTAATGCGACCCTTGCCCAAGGTTTCGAATAAGTCCAAGCTGGGATTGAAACCCAGGCGT CTGTGACCCCAGAACTCCTGATCTTTCCACTGCACTGTGCCGCCTCGGTGAACAGATGCGGGG AATTTACAGTTTCTCTTTTCCACCGCCCACGACTACACAAAATCAGTCACACTGACGCTGAGGGT GGGGAACGGGAAGAGGGTGGGGAGGTTATTTGGAGGCCAGCGGGGGGTGAGGGGTGGCT GATGCAATGACCAGCTAATGGCTCGATTCTCAAGA |
| 2876 | WARS | 3579587 | GTTGGTCCAAGGCACAGCGCTTTCTGAAGGAACAGGAAGTGAAAGGAAGGCGAGCGGCTAT GAGAGACCGCGTTAAGCGGCACGGGGCGCTTTAGGCGCTGCCCAGTCCCGGCCCCTCCAGCC CGGGGCCCGCCGCTCACCACACGCACCGGAAGCGTCGGTTCTCCCGGAGGCAGACCGGCCA GCACACTACCATCCAGTCACGTTCCGACGCGACGCCGCGGCCGCCAGCCAATCAGTGGCGGC CTCTGCCCCGCCCCCGCGCGAACAGCCAATGACGGCGCCGTCGGGCCGGAAGTTGTTCCGTC CGGACGGCGTTTCCACGGACGCCCAGGAGACA |
| 2877 | THBS1 | 3589468 | GATCCCTGCTGGGCACCAACAGCTCCACC |
| 2878 | THBS1 | 3589469 | GCCTGGGGACTAGGCGTCCTGTTCCTGATGCATGTGTGTGGCACCAACCGCATTC |
| 2879 | THBS1 | 3589470 | TTCCGCATCGAGGATGCCAACCTGATCCCCCCTGTGCCTGATGACAAGTTCCAAGACCTGGTG GATGCTGTGCGGGCAGAAAAGGGTTTCCTTCCTTCTGGCATCCCTGAGGCAGATGAAGAAGAC CCGGGGCACGCTGCTGGCCCTGGAGCGGAAAGACCACTCTGGCCAGGTCTTCAGCGTGGTGT CCAATGGCAAGGCGGGCACCCTGGACCTCAGCCTGACCGTCAAGGAAAGCAGCACGTGGT GTCTGTGGAAGAAGCTCTCCTGGCAACCGGCCAGTGGAAGAGCATCACCCTGTTTGTGCAGG AAGACAGGGCCCAGCTGTACATCGACTGTGA |
| 2880 | THBS1 | 3589474 | TGGCCAATGAGCTGAGGCGGCCTCCCCTATGCTATCACAACGGAGTTCAGTACAGAAATAAC GAGGAATGGACTGTTGATAGCTGCACTGAGTGTCA |
| 2881 | THBS1 | 3589475 | CTGCAAAAAGGTGTCCTGCCCCATCATGCCCTGCTCCAATGCCACAGTTCCTGATGGAGAA |
| 2882 | THBS1 | 3589477 | CTCACGGCCAGTTGGAGCCAGAACCAACAACAGCTCGGCTGCCTTCACACTCATCTGTCAAA CACATGGTGTATAGGCTCCCCTGACAGAAATGACTCCTATAAGCTTCCTCATACTCGCGCATTCT TGGAAGTCTGAGACTGGAAATGCCTACCCAGATATGTTAAGTCAGTAAAGGAAAACTCATTT GCAATGCTGAGAGGAGAAAGAAAATCAATGAATAGGAGAGCATACACTGTGGGAAGGCTCA GCTGTACTGAGCCAGGCAAAGCATCCGATTACCCACTGCTGTACACATCATGACCTGGGATA AACCCCTGGGCCGTTGGCCTAAGAAATATGTTGCTTTTCATCCTGTATAACTGCAACTTTGTGC CGGCTCATA |
| 2883 | THBS1 | 3589479 | CATGGTCCGAGTGGACCTCCTGTTCTACGAGCTGTGGCAATGGAATTCAGCAGCGCGGCCGC TCCTGCGATAGCCTCAACAACCGATGTGAGGGCTCCTCGGTCCAGACACGGACCTGCCACCATT CAGGAGTGTG |
| 2884 | THBS1 | 3589482 | GATGGTGTGATCACAAGGATCCGGCTCTGCAACTCTCCCAGCCCCCAGATGAACGGGAAACC CTGTGAAGGCGAAGCGCGGG |

TABLE 13-continued

Subtyping Target Sequences

| SEQ ID NO. | Gene | Affy Probeset ID | Sequence |
|---|---|---|---|
| 2885 | THBS1 | 3589483 | CCAGCTGGTTGCCTGGCATCTGCAGCCTGCAGTTCAGTGGGTCATAGAGCAGGAAGGTTACC<br>TACTAGAGAAACAAACAGAAGCAAAGTCCTGCAGGCTCAGCAACTTCTTTTAATGAAA |
| 2886 | THBS1 | 3589484 | GGTCACCATGGGACATCTGTTCTGTCACCTGTGGAGGAGGGGTACAGAAACGTAGTCGTCTC<br>TGCAACAACCCCACACCCCAGTTTGGAGGCAAGGACTGCGTTGGTGATGTAACAGAAAACCA<br>GATCTGCAACAAGCAGGACTGTCCA |
| 2887 | THBS1 | 3589485 | GCCACGCAGCCCAGGATGAAACGACCCAGG |
| 2888 | THBS1 | 3589486 | TGCTTTGCCGGCGTGAAGTGTACTAGCTACCCTGATGGCAGCTGGAAATGTGGTGCTTGTCCC<br>CCTGGTTACAGTGGAAATGGCATCCAGTGCACAGATG |
| 2889 | THBS1 | 3589487 | TCAACCACAATGGAGAGCACCGGTGTGAGAACACGGACCCCGGCTACAACTGCCTGCCCTGC<br>CCCCCACGCTTCACCGGCTCACAGCCCTTCGGCCAGGGTGTCGAACATGCCACGGCCAACAAA<br>CA |
| 2890 | THBS1 | 3589489 | GATGGGACCCACGACTGCAACAAGAACGCCAAGTGCAACTACCTGGGCCACTATAGCGACCC<br>CATGTACCGCTGCGAGTGCAAGCCTGGCTACGCTGGCAATGGCATCATCTGCGGGGAGGACA<br>CAGACCTGGATGGCTGGCCCAATGAGAACCTGGTGTGCGTGGCCAATGCGACTTACCA |
| 2891 | THBS1 | 3589491 | ATTGCCCCAACCTTCCCAACTCAGGGCAGGAAGACTATGACAAGGATGGAATTGGTGATGCC<br>TGT |
| 2892 | THBS1 | 3589493 | CATTCCATTACAACCCAGCTCAGTATGACTATGACAGAGATGATGTGGGAGACCGCTGTGAC<br>AACTGTCCCTACAACCACA |
| 2893 | THBS1 | 3589495 | TATCCTCAATGAACGGGACAACTGCCAGTACGTCTACAATGTGGACCAGAGAGACACTGATA<br>TGGATGGGGTTGGAGATCAGTGTGACAATTGCCCCTTGGAACACAATCCGGATC |
| 2894 | THBS1 | 3589497 | GGACTCTGACTCAGACCGCATTGGAGATACCTGTGACAACAATCAGGATATTGATGAAGATG<br>GCCACCAGAACAATCTGGACAACTGTCCCTATGTGCCCAATGCCAACCAGGCTGACCATGACA<br>AAGATGGCAAGGGAGATGCCTGTGACCACGATGATGACAACGATGGCATTCCTGATGACA |
| 2895 | THBS1 | 3589498 | TGACATCAGTGAGACCGATTTCCGCCGATTCCAGATGATTCCTCTGGACCCCAAAGGGACATC<br>CCAAAATGACCCTAACTGGGTTGTACGCCATCAGGGTAAAGAACTCGTCCAGACTGTCAACTG<br>TG |
| 2896 | THBS1 | 3589500 | TATGATGAGTTTAATGCTGTGGACTTCAG |
| 2897 | THBS1 | 3589501 | ACCGAAAGGGACGATGACTATGCTGGATTTGTCTTTGGCTACCAGTCCAGCAGCCGCTTTTAT<br>GTTGTGATGTGGAAGCAAGTCACCCAGTCCTACTGGGACACCAACCCCACGAGGGCTCAGGG<br>ATACTCGGGCCTTTCTGT |
| 2898 | THBS1 | 3589502 | GTAAGAAGCAAAGCCCTGGAACAGAGAGAGAGCTTATGG |
| 2899 | THBS1 | 3589503 | TGTGCTTTGACCAAGACTCTGACCAGGGAGTCTTAGAAAGTTCCCAGCATCACCAGCTGCAGC<br>ATTGAACTCTGCTTTGTAAAAACATAATAGTGTTGAAAAGGGAGCTTGACCAAGAATTGCCCT<br>GCAAATCCTAAGGTGCCTTCAGCCTTTTCAAACAAAAAAACCTCCTTCCCTCCTCTCTGTCTGCT<br>TTATATGTGTGCTCAGTGGCACACAACAAATATGAGAGGACTTGGAAAAATTCCCCATTGCAG<br>CCCTCTAACTTAGATCAGCTCAGTACCTTTCAAGCATTGTTTC |
| 2900 | THBS1 | 3589504 | CCTGTGGCATGACCCTCGTCACATAGGCTGGAAAGATTTCACCGCCTACAGATGGCGTCTCAG<br>CCACAGGCCAAAGACGGGTTTCATTA |
| 2901 | THBS1 | 3589505 | GCTGACTCAGGACCCATCTATGATAAAACCTATGCTGGTGGTAGACTAGGGTTGTTTGTCTTC<br>TCTCAA |
| 2902 | THBS1 | 3589509 | GCTGGTATTGCACCTTCTGGAACTATGGGCTTGAGAAAACCCCCAGGATCACTTCTCCTTGGC<br>TTCCTTCTTTTCTGTGCTTGCATCAGTGTGGACTCCTAGAACGTGCGACCTGCCTCAAGAAAAT<br>GCAGTTTTCAAAAACAGACTCAGCATTCAGCCTCCAATGAATAAGACATCTTCCAAGCATATA<br>AACAATTGCTTTGGTTTCCTTTTGAAAAAGCATCTACTTGCTTCAGTTGGGAAGGTGCCCATTC<br>CACTCTGCCTTTGTCACAGAGCAGGGTGCTATTGTGAGGCCATCTCTGAGCAGTGGACTCAAA<br>AGCATTTTCAGGCATGTCAGAGAAGGGAGGACTCACTAGAATTAGCAAACAAAACCACCCTG<br>ACATCCTCCTTCAGGAACACGGGGAGCAGAGGCCAAAGCACTAAGGGGAGGGCGCATACCC<br>GAGACGATTGTATGAAGAAAATATGGAGGAACTGTTACATGTTCGGTACTAAGTCATTTTCAG<br>GGGATTGAAAGACTATTGCTGGATTTCATGATGCTGACTGGCGTTAGCTGATTAACCCATGTA<br>AATAGGCACTTAAATAGAAGCAGGAAAGGGAGACAAAGACTGGCTTCTGGACTTCCTCCCTGA |
| 2903 | THBS1 | 3589510 | TGGCCAGAATTAGGGAATCAGAATCAAACCAGTGTAAGGCAGTGCTGGCT |
| 2904 | THBS1 | 3589511 | AGGGGCAGCCGTGCTTATATTTTTATGGTTACAATGGCACAAAATTATTATCAACCTAACTAA<br>AACATTCCTTTTCTCTTTTTTCCTGAATTATCATGGAGTTTTCTAATTCTCTCTTTTGGAATGTAG<br>ATTTTTTTTAAATGCTTTACGATGTAAAATATTTATTTTTACTTATTCTGGAAGATCTGGCTGA |

TABLE 13-continued

Subtyping Target Sequences

| SEQ ID NO. | Gene | Affy Probeset ID | Sequence |
|---|---|---|---|
| | | | AGGATTATTCATGGAACAGGAAGAAGCGTAAAGACTATCCATGTCATCTTTGTTGAGAGTCTT CGTGACTGTAAGATTGTAAATACAGATTATTTATTAACTCTGTTCTGCCTGGAAATTTAGGCTT CATACGGAAAGTGTTTGAGAGCAAGTAGTTGACATTTATCAGCAAATCTCTTGCAAGAACAGC ACAAGGAAAATCAGTCTAATAAGCTGCTCTGCCCCTTGTGCTCAGAGTGGATGTTATGGGATT CTTTTTTTCTCTGTTTTATCTTTTCAAGTGGAATTAGTTGGTTATCCATTTGCAAATGTTTTAAAT TGCAAAGAAAGCCATGAGGTCTTCAATACTGTTTT |
| 2905 | THBS1 | 3589512 | GTTCTCTACTGGCTTTATGTCATGAAGTATATGCGTAAATACCATTCATAAATCAATATAGCAT ATACAAAAATAAATTACAGTAAGTCATAGCAACATTCACAGTTTGTATGTGATTGAGAAAGAC TGAGTTGCTCAGGCCTAGGCTTAGAATTTGCTGCGTTTGTGGAATAAAAGAACA |
| 2906 | THBS1 | 3589513 | CATTAGCCTGCCATATCAAAAACATATAAAAGAGAAATTATCCCTAAGTCAAGGGCCCCCATA AGAATA |
| 2907 | THBS1 | 3589514 | TTAGATGTCATTGAATCCTTTTCAA |
| 2908 | THBS1 | 3589515 | AGCGACATTTTCTGACCCACGAATGATGCCTTGGGTGGGCAACACGATTGCATGTTGTGGAG ACACTTCGGAAGTAAATGTGGATGAGGGAGGAGCTGTCCTTGCAATGTTGAGCCAAGCATTA CAGATACCTCCTCTTGAAGAAGGAATAATAAGTTTAATCAAAAAAGAAGACTAAAAAATGTA AAATTTGGAAGGAATCCATAAATGCGTGTGTGTCTAAATACAAATTATCATGTGAAGAAAAG GCCCAAGTGTACCAATAAGCAGACCTTGATTTTTGGATGGGCTAATTATGAATGTGGAATACT GACCAGTTAATTTCCAGTTTTAATGAAAACAGATCAAAGAAGAAATTTTATGAGTAGGTTAAA GGTCTGGCTTTGAGGTCTATTAAACACTAGAAAGGACTGGCTGGGTGAGATAAAATCTTCTT GTTGATTTTCACTCTCATTCTATAAATACTCATCTTTCTGAGTAGCCATGATCACATACAAATGT AAATTGCCAAATCATTTTATAGTACCAAGGTGAAGAAGCAGGAACTAGAAAGTGTTGATAAT AGCTGTGGAGTTAGGAAAACTGATGTGAAGGAAATAATTCTTTGAAATGGCAAAGAATTAAA TACCATCATTCATTATCAGAAGAGTTCAACGTTTGAAGTGCTGGGAGATAATTCTAATTCATTC TTGGATAGTGAAGCAAAACTGATTGAAAATACCAAGATAAGACAGAAAAAGTGACTGGAAA GAGGGAGCTTTTCTTCCAGGCATGTTCCAGTTTCACC |
| 2909 | THBS1 | 3589516 | GTCATCGAGATGATAGCTTTTTTCCTCCTCCAACAGTTTATTGTCATGTGTTGTGGGAGAGCTC GAGTGAAGAGCAATAAACTCCAGGTCTTATAAGAATGTACATACAATAAAGGTGGTGCCAGC AGTTTTTTTTTTTCTAAAGAGTCACATGTAGAAAAGCCTCCAGTATTAAGCTCCTGA |
| 2910 | CYP1A1 | 3601834 | TCATCCTGGAGACCTTCCGACACTC |
| 2911 | ADAM10 | 3626562 | AAGGCGCTTCGCTTTTCAGACCTGGGCGTCTGTATCATGACTATCATAAATTTAGGATTAAGA CACCTAGCCTCCTACCAGGATGAATGAGGTGTCCATGTGACCTGCTGTGCCCTGGAATTTTAT ACATCTTTCTCTCATAGCACACACCATATTACAATATAATCCTGCCTCATCTAAGCCAAACTTTC GAGAGAATCATTTACACTCAGTGGCTACTTCAGCTCCCATTCACTTATCAACCTGCTGCAATTT TTCACAGCCCCCAAAGGACTGCAGTCTGTGCCTTCAGGGAGCTGAGGGTCTAGCGGAAGGAA AGAAACCAGCAGTTACAGTACAGAGGGGTTTGTGTTGGAAACTCTACAAACACAGGATGCCC TGGTAGCTCAGAGGAAGTGCATATCGAGCATGGTAGGTAGGTAGTGGGAAGAGCCAAGATG ACTTCCCAGAGGAGAAAAGCTGGACCTGAGTTTTGGAGTTTCGGTAAAAGTTTGCTCTAACTA GTCCAAGCTGCTGTCACAAGCTTTTAGAAATGATGTAACCATGGGGCAGTTGACTGTCGTCAT GTTCTTTGCTATTTTCATGACTCTGGATGTGCTTTTCCTATTCCCTGGATTGCCCTTTCCCTCGAT TCCTCTGCAGGACTGGGCTTTATTA |
| 2912 | ADAM10 | 3626563 | CAAAGTTTTGAATGCTAAGTACCTCATTTATTTTAAAAAGCCTAGTTTAATGATAAGTTTGTTT AAAATTTTGAGCCATCATTTTTCTCTTCATAGCAAATAAGGAGAGAATTGACATTTCAGTGTTA CCTAGAAAAGGAATTGTAAGCCCAGAATAATTCCCTGCATGAGGTAATCTGCTTCAAA |
| 2913 | ADAM10 | 3626564 | TACTCTTTGAACTCTGAGAACTATCACAAGAAGCTTCCCACAAGGCAGTGTTTTCTTACAGTTG TCTCTTCCTACAAAAGTATAGATTATCTTTATTCTTAATACTTTGGAATCCATGTAGAAAATTTC CAGTTAGATACTCTGCGTACACACAATAAACCTTTT |
| 2914 | ADAM10 | 3626565 | AAACTTGAAATGCATTAATAAATAG |
| 2915 | ADAM10 | 3626566 | GCTGCTACGGGCACAAGTGACTATACTGAAGAACACAGTTAAGTGTTGTGCAAACTGGACAT AGCAGCACATACTACTTCAGAGTTCATGATGTAGATGTCTGGTTTCTGCTTACGTCTTTTAAAC TTTCTAATTCAATTCCATTTTTCAATTAATAGGTGAAATTTTATTCATGCTTTGATAGAAATTAT GTCAATGAAATGATTCTTTTTATTTGTAGCCTACTTATTTGTGTTTTTCATATATCTGAAATATG CTAATTATGTTTTCTGTCTGATATGGAAAAGAAAAGCTGTGTCTTTATCAAAATATTTAAACGG TTTTTTCAGCATATCATCACTGATCATTGGTAACCACTAAAGATGAGTAATTTGCTTAAGTAGT AGTTAAAATTGTAGATAGGCCTTCTGACATTTTTTTTCCTAAAATTTTTAACAGCATTGAAGGT GAAACAGCACAATGTCCCATTCCAAATTTATTTTTGAAACAGATGTAAATAATTGGCATTTTAA AGAGAAAGCAAAACATTTAATGTATTAACAGGCTTATTGCTATGCAGAAAATAGAAGGGGC ATTACAAAAATTGAAGCTTGTGACATATTTATTGCTTCTGTTTTCCAACTACATCACTTCAACTA GAAGTAAAGCTATGATTTTCCTGACTTCACATAGGAGGCAAATTTAGAGAAAGTTGTAAAGAT TTCTATGTTTTGGGTTTTTTTTTTCCTTTTTTTTTTAAGAGTATAAGGTTTACACAATCATTCTC ATAATGTGACGCAAGCCAGCAAGGCCAAAAATGCTAGAGAAAATAACGGGATCTCTTCCTTG TAAACTTG |

TABLE 13-continued

Subtyping Target Sequences

| SEQ ID NO. | Gene | Affy Probeset ID | Sequence |
|---|---|---|---|
| 2916 | ADAM10 | 3626567 | GGCTCGACCACCTCAACATTGGAGACATCACTTGCCAATGTACATACCTTGTTATATGCAGAC ATGTATTTCTTACGTACACTGTACTTCTGTGTGCAATTGTAAA |
| 2917 | ADAM10 | 3626568 | TATATTTTTTTCAACTGCCAATCAAG |
| 2918 | ADAM10 | 3626569 | AGATCATATCCTCAGACCAGGTGGAATTACTTAAATTTTAAAGCCTGAAAATTCCAATTTGGG GGTGGGAGGTGGAAAAGGAACCCAATTTTCTTATGAACAGATATTTTTAACTTAATGGCACAA AGTCTTAGAATATTATTATGTGCCCCGTGTTCCCTGTTCTTCGTTGCTGCATTTTCTTCACTTGC AGGCAAACTTGGCTCTCAATAA |
| 2919 | ADAM10 | 3626570 | CCAAAGAGAAACCTATTAAGTCATCATCTCCAAACTAA |
| 2920 | ADAM10 | 3626571 | CTGCAGCTTTTGCCTTGGTTCTTCCTAG |
| 2921 | ADAM10 | 3626572 | CAGCGGCCCCGAGAGAGTTATCAAATGGGACACATGAGACGCTAA |
| 2922 | ADAM10 | 3626574 | CTCATTGGTGGGCAGTATTACTTATGGGAATTGCTCTGATCATGCTAATGGCTGGATTTATTAA GATATGCAGTGTTCATACTCCAAGTAGTAATCCAAAGTTGCCTC |
| 2923 | ADAM10 | 3626578 | TCTGTTTTACCGTGCTCCTTAGTTCATCTCCTGGATGGGTTACTTCTTTTGGTGCATATTATTAG GGCATTTTCATGGGACTTAAAAAACATTTTTTTTTGTTGTTTTTCAAGCAACTTATTTGCCCAA ATCGTGGACTAATTGGTGATTTTTCCTGATCTTTCAGTATAATCTCTGGGTCTTTATCTTGTTTG TAATAGGAAATGTTGAACAGAATAAGATCAGATACACAGCCTTTTGTAGATCTACTAATGATT ATGGATGTTCATCCAGCAGTAATCCACTGAACGCTTATTTTTAAGCCCACATATCTCCAAGTTG TACAAACACAGAATTACCTGATGTTTTCTTAAAAGATTGTCAAGATTGACTATCTCAACTTAAG TGTTCATGCTTTAAAAGTGATAACATTAAAATATCTATAGGAAGCTTGCAAATGATATATTTGA GAATGTGCTATAATTGAACTGAATGTAGTTTGCTTTGGAAATTGACTTATAACTCACATTCCCC TTTCTCAAATTAGTGTGTATGTGTGTGTGTGTATGTATGTATGTGTGTGTTCAGAACTATGG ATGCCTTAAAGCACAAAAGATGTTGTTTGTGTGGGATGTCAGCCTTTTTTGTACTCTTCTAATA ACATTCTAGAGTAAAAATTTTATAGTTAACCCCAGCATTTAAAATGATGTTTACCGTTCCTAGG ACACATTAGGATATGTGGTTTTTAGATATGTAATGATCATGGAGTAGAAGGATTGTTGAAATT GGATTTAGGAGATCTACCTAGGTTTCAAACCAAATACTTGAGCAGTTGACTTAACTTAGGTTT CCTTAAAACATGTTACTCTTTTTTAAATTCCTGTGCTTGTTGCGTGGTAAGTTC |
| 2924 | ADAM10 | 3626579 | TAGGCACTTCAGTGGTCGAACCATCACCCTGCAACCTGGATCCCCTTGCAACGATTTTAGAGG TTACTGTGATGTTTTCATGCGGTGCAGATTAGTAGATGCTGATGGTCCTCTAGCTAGGCTTAA AAAAGCAATTTTTAGTCCAGAGCTCTATGAAAACATTG |
| 2925 | ADAM10 | 3626580 | TGGACCCATCAACTTGTGCCAGTACAG |
| 2926 | ADAM10 | 3626581 | TGACCTACAGTTTGGCCAGATAATTTCCAGCTAAATCTGTCCTCTTGAGGAGATTATAAATGTA ACGTAGCATTGTGTCTCTATTATTATGGTCTCTACAATGTTTTAAAAATGATAAACTAGACAAA ACGTTGCCAGCTTTACAGCAGTAATTTACATAAACACTGTTAGACTTTAAGTCATCGTGGACAC TGAGTCAAGACTTGCTGGTTGCTTGTTTACATTGTAACATTTAATATGAATTACTGATGGCGTT ACCCAGCCTAACTAGAGA |
| 2927 | ADAM10 | 3626582 | TCTGTGAGAAATATGGCTTAGAGGAGTGTACGTGTGCCAGTTCTGATGGCAAAGATGATAAA GAATTATGCCATGTATGCTGTATATGAAGAAAA |
| 2928 | ADAM10 | 3626583 | CCATGTACATGTGGTTGATATTCTCTAGAGAAACATAGTTGTACAACTCGGCATGTGATTTGTC TATAATATTTAAGTTTTATAAAATAATATTTCAGTAGCCTAAATAAAAGAACTCTTTGGTCATCT TCTCTGAATATCAAACCTTCCAAAGCTTTTGTGGCTGAATATCACTTTGCTCTACAGGAAAAAA TTTAATTTTTCTTTCTTTATAGAAGAGCCGTAATAACCAACATAAAATCGATCCTCATCTAATCT CTTGCTCTGCTTTTATTTCATTTTTTTAAGTTGCCATTGCTTTAAAAGATTTACTATCTTTCTTGG ATTTACTGTTTTTCAAATTTTTTCAAATGTATTTATGTAATTCAGTTTTGATACTCATCTCTGTTT GTTTTTCACTTTCATTTCCATTTAAATATTTTGACATTGGAAGCTCATACTTGCCTGTCTGTTACT ATAA |
| 2929 | ADAM10 | 3626584 | GTCAAGGTCCTTGTTGTACAGCACAGTGTGCATTCAAGTCAAAGTCTGAGAAGTGTCGGGAT GATTCAGACTGTGCAAGGGAAGGAATATGTAATGGCTTCACAGCTCTCTGCCCAGCATCTGAC CCTAAACCAAACTTCACAGACTGTAATAGGCATACACAAGTGTGC |
| 2930 | ADAM10 | 3626585 | TGTAAAGATGAATGCTGCTTCGATGCAAATCAACCAGAGGGAAGA |
| 2931 | ADAM10 | 3626588 | ACATCATGTATGCAAGAGCAACATCTGGGGACAAACTTAACAACAATAAATTCTCACTCTGTA GTATTAGAAATATAAGC |
| 2932 | ADAM10 | 3626589 | CACTGGAATTATTACTGTTCAGAACTATGGGTCTCATGTACCTCCCAAAGTCTCTCACATTACT TTTGCTCACGAAGTTGGACATAACTTT |
| 2933 | ADAM10 | 3626590 | TCTGGAGGAATATGTGAAAAAGTA |
| 2934 | ADAM10 | 3626592 | GATTTTGATGATGGCGTACTTGGTCTGGCTTG |

TABLE 13-continued

Subtyping Target Sequences

| SEQ ID NO. | Gene | Affy Probeset ID | Sequence |
|---|---|---|---|
| 2935 | ADAM10 | 3626593 | TCCCAAATATTGGTGTGGAGAAGTTTCTGGAATTGAATTCTGAGCAGAATCATGATGACTACTGTTTGGCCTATGTCTTCACA |
| 2936 | ADAM10 | 3626595 | TCCAGTCATGTTAAAGCGATTGATACAATTTACCAGACCACAGACTTCTCCGGAATCCGTAACATCAGTTTCATG |
| 2937 | ADAM10 | 3626596 | CTGCTAATGGTCCAGAACTTCTGAGGAAAAACGTACAACTTCAGCTGAAAAAATACTTGTCAGCTTTATATTCAGACTGATCATTTGTTCTTTAAATATTACGGAACACGAGAAGCTGTGATTG |
| 2938 | ADAM10 | 3626602 | GCTTCCTGAGACCTCTCTAGAAGCCAAGCGGATGC |
| 2939 | ADAM10 | 3626607 | TGAGGAAATACCAGATGACTGGTGTAGAGGAAGTAACAC |
| 2940 | ADAM10 | 3626613 | GGCTTAGAAAACTTATGTCACTTGATTGTGGACCTCCTGTTCTTTACCCTGTGCTCTTCTGCTTCACTCATGGAAGAAAGC |
| 2941 | ADAM10 | 3626614 | GGAAGTTTTAGCCATGGGTCTGTTATTGATGGAAGATTTGAAGGATTCATCCAGACTCGTGGTGGCACATTTATGTTGAGCCAGCAGAGAGATATATTAAAGACC |
| 2942 | ADAM10 | 3626615 | CATTTCAACCTACGAATGAAGAGGGACACTTCCCTTTTCAG |
| 2943 | ADAM10 | 3626631 | CCATTAATCTCCAGCGTTCATTCGACTGATCTGG |
| 2944 | ADAM10 | 3626635 | AGGATTATCTTACAATGTGGATTCATTACACCAAAAACACCAGCGTGCCAAAAGAGCAGTCTCACATGAAGACCAATTTTTACGTCTAGATTTCCATGCCCATGG |
| 2945 | ADAM10 | 3626640 | ATTTCCAGAGTCCTTTATTGCATTAAGCATTGGTTAAAAGGCTAATTTTGGTGTTTTTGTTAAGCAGAACTTTTTCAAAAAACATAAGACAAGTTTTATTAGTTTTATTTTAAAATTAGTATCAAGATTCTAGCTTTTGGGTACTTGGAGATACTTGTAATTTTATTGTAACTATGGGGTATTTTTATCTACTAATCTGAGCTATTTTTGGTCACTTGTAAGATCTTTGTATGATGATTTGTAGACTTCAGCACATTGAGATTG |
| 2946 | ADAM10 | 3626641 | CATCAAGCAAGACACACATTATAGATTAAGAGCTGATAATAGATGTTTAGTTTTAAAAGGATTATGTGCGGGAGACTCTCTGTTAGAGGAGCCTTTTTCATCTGACATTTGTTATTTCTGTTCTAAACGTGGCTTTC |
| 2947 | ADAM10 | 3626642 | TTTCTGTCCTGTATTCTACCGAGTCCGAGGGTGGTA |
| 2948 | ADAM10 | 3626643 | GCTTTGGATGAGTGTCTGTAGCCTTTGATAATTTAGAAAATATCTATTTCATGTAATGTATTGTTTCTGTTTTTTTCTTTGCCACTTTGACTTATGACTGCAG |
| 2949 | ADAM10 | 3626644 | TCTCTTAGAGTAGAAGTTCGGTCCCTGGGTGACCCAACTTGAAGAGTTTCGTTAAACTTTCAGGTGGAGTAGATGTACAGTGTAGTTAGTGGATTGTCAAAA |
| 2950 | ADAM10 | 3626645 | ACCATTTGGGGATGTTCTTTGATTT |
| 2951 | ADAM10 | 3626646 | CTCGTGGGAAGTTGTGTTGTTTGCAGCTGGGCTCGTGTATTGTTCTTTACCCGGCGCGCCGGTCCTGACCGACCCCATTCTGCAGAGGGGCCGCCCGTGGAGTGGCAGCAGTCATCACCCGCTTATCTGAGACTAGTGGCCTCGGTTC |
| 2952 | ADAM10 | 3626648 | ATGGTGTTGCTGAGAGTGTTAATTCTGCTCCTCTCCTGGGCGGCGGGGATGG |
| 2953 | ADAM10 | 3626649 | CTTCTCCCTCCGGATCGATGTGCTGCTGTTAACCCGTGAGGAGGC |
| 2954 | ADAM10 | 3626650 | TCCCTGTTTTGGAGGAGCTAGGAGCGTTGCCGGCCCCTGAAGTGGAGCGAGAGGGAGGTGCTTCGCCGTTTCTCCTGCCAGGGGAGGTCCCGGCTTCCCGTGGAGGCTCCGGACCAA |
| 2955 | ADAM10 | 3626651 | CGGCAGGCCTAGCAGCACGGGAACCGTCCCCCGCGCGCATGCGCGCGCCCCTGAAGCGCCTGG |
| 2956 | ADAM10 | 3626653 | GCTAGGGTGAACTCTTGAAGCTATCAGTCATCCAGCAATCTTAGCAAGCAGGCCATTGGGTCCCTGTTTGCTCTGTCTCTCTCTCTCTCACTGTTGAAGGGCTTAGCTAACTACTTAAGTAAAATATTTGTTCTCTGTTAAACATGTCAAGGAGTATGGTCAGCTTATCCACATTAAGCCTGTGTGTCCCACGTTGGAGTAAATGTTAAGTAGCTCACTACAATAAACTAGATTCTTCTGCCCTCTCTTGTTTAAATGATCATGTTCCCTGGAGGTGGAAATAGATCTTTA |
| 2957 | ADAM10 | 3626654 | TGGCCAAGGCTGAGATAACTTTAGCATCAGCAAGGATAATATCTGCAAGAGATTGAAACTCATAGTATTGTATTTAACTCTGTGAGTTAATGATGGTAGTGGACAGAATTATAGTTACCTTTGGGATACGCTTTTAAAGAAATTCCAGGTAATAAGAGAAATGATAGAATTAGGATATCACCATTTTACCCCCCCCAACAATTTATGGATCTAGACAATAATCGCCAGTGACTGCTAACCTCACAAAGTGAGAGCAATCAGATTTTGTGCCTCCTAATGGAAGTACATATACCACCTATGAAGCAGTTCTGCCAAAAGTCACATCTCATCATGATGAAGCCTCCTGATCTAACTACC |

TABLE 13-continued

Subtyping Target Sequences

| SEQ ID NO. | Gene | Affy Probeset ID | Sequence |
|---|---|---|---|
| 2958 | ADAM10 | 3626655 | TTGATTGGGCAGACCCAGGGAAGTCAAATCCTAAACCAGCAGTGGGAACACAACAGAATGGT GTAGTTTGCACTGGTAAGATTTGGGTACC |
| 2959 | CYP1A1 | 3633082 | CAGCAGGCTGGCCTATGTGGTCTAAGGTTCAGCCTGAAACTCATAGACACTGATCTGGCTGCA GTTTTGCTATCTGGGCTGTGGGCAAGCCTAAGGGATCCTGCCTGCCCCTACCCTGGACTTGCC TCTGCACACCCTCCAGAGACAACAGGTAAAACAGGGCCACATAGATGCTGATGGAGCCTTCC CAAGTTGTGCTTGAGCCAGGAGGCCTGCTAGGGTTAGGAGGTCCTTAGGCCTCTGAGAAGCT CTGAAGAACTCTCTGGAAGCCCCTGGGCCCAGTACCTAGCTGGCTCTGTGAGGGTGCTGACT GGCTTCAGCAAGTTAGAACTAGCCAAACCAGGACCCTGTCCAATCTTTGACAATTGGGAGCTG CCAAGAGTGAAGGGAAGAGACAGCCCAGGATACTGGCACAGAGGTAGTCTCACTGCTTGAA CTAGGCTGA |
| 2960 | CYP1A1 | 3633083 | GTGAGCACTTCCAAATGCAGCTGCGCTCTTAG |
| 2961 | CYP1A1 | 3633084 | CCCTGATGGTGCTATCGACAAGGTGTTAAGTGAGAAGGTGATTATCTTTGGCATGGGCAAGC GGAAGTGTATCGGTGAGACCATTGCCCGCTGGGAGGTCTTTCTCTTCCTGGCTATCCTGCTGC AACGGGTGGAA |
| 2962 | CYP1A1 | 3633085 | ACACAAGTTTGAAAGGCTTTTACATCCCCAAGGGGCGTTGTGTCTTTGTAAACCAGTGGCAGA TCAACCATGACCA |
| 2963 | CYP1A1 | 3633087 | TCATCCTGGAGACCTTCCGACACTC |
| 2964 | CYP1A1 | 3633089 | GTTTGACACAGTCACAACTGCTATCTCCTGGAGCCTCATGTATTTGGTGATGAACCCCAGGGT ACA |
| 2965 | CYP1A1 | 3633090 | AAGCAGCTGGATGAGAACGCCAATGTCCAGCTGTCAGATGAGAAGATCATTAACATCGTCTT GGACCTCTTTGGAGC |
| 2966 | CYP1A1 | 3633091 | TGGCCTCTGATTGGGCACATGCTGACCCTGGGAAAGAACCCGCACCTGGCACTGTCAAGGAT GAGCCAGCAGTATGGGGACGTGCTGCAGATCCGAATTGGCTCCACACCCGTGGTGGTGCTGA GCGGCCTGGACACCATCCGGCAGGCCCTGGTGCGGCAGGGCGATGATTTCAAGGGCCGGCC CGACCTCTACACCTTCACCCTCATCAGTAATGGTCAGAGCATGTCCTTCAGCCCAGACTCTGGA CCAGTGTGGGCTGCCCGCCGGCGCCTGGCCCAGAATGGCCTGAAAAGTTTCTCCATTGCCTCT GACCCAGCCTCCTCAACCTCCTGCTACCTGGAAGAGCATGTGAGCAAGGAGGCTGAGGTCCT GATAAGCACGTTGCA |
| 2967 | CYP1A1 | 3633092 | ATGTCGGCCACGGAGTTTCTTCTGGCCTCTGTCATCTTCTGTCTGGTATTCTGGGTAATCAGGG CCTCA |
| 2968 | CYP1A1 | 3633093 | CACCTCCAAGATCCCTACACTGATC |
| 2969 | CYP1A1 | 3633094 | GTGATCCCAGGCTCCAAGAGTCCACCCTTCC |
| 2970 | CYP1A1 | 3633095 | GGAGGCGTGGCCACACGTACAAGCCCGCCTATAAAGGTGGCAGT |
| 2971 | SCNN1B | 3652907 | CAGTGTCACCAACACTCGGCCGCCGCCGCCAGCTTGGCGCGCACCGCCGCCTCCGCCACCGCC GACAGCGCGCATCCTCCGTGTCCCCGCTCC |
| 2972 | SCNN1B | 3652909 | ATCACCAGTTATCCATGCTGCTGCATATAAACCCAGCTTATTTATTTAAACTGCTGCATGGATT CCCGCCGTGGATAATGCCTACCGATGGGAATTTAGGTGACA |
| 2973 | SCNN1B | 3652921 | TGAAGGGCCTGCATCGGCTGCAGAAGGGCCCCGGCTACACGTACAAGGAGCTGCTGGTGTG GTACTGCGACAACACCAACACCCACGGCCCCAAGCGCATCATCTGTGAG |
| 2974 | SCNN1B | 3652922 | GTCTCCCTCTCCGTAGGCTTCAAGACCATGGACTTCCCTGCCGTCACCATCTGCAATGCTAGCCC |
| 2975 | SCNN1B | 3652924 | ATGCCAATGCCACCAGGAACCTGAACTTCTCCATCTGGAACCACACACCCCTGGTCCTTATTGA TGAACGGAACCCCACCACCCCATGGTCCTTGATCTCTTTGGAGACAACCACAATGGCTTAAC AAGCAGCTCAGCATCAGAAAAGATCTGTAATGCCCACGGGTGCAAAATGGCC |
| 2976 | SCNN1B | 3652925 | GTGGTCCCTGGGCACATATCAAGCAATGGGCCCCACCCAGTGAGGCTGATGGGTGTTTCTTTT CTGTAGTAATTTGAGTCTCGCTGGG |
| 2977 | SCNN1B | 3652926 | CGGAACTTCACCAGTGCTACCCAGGCATTG |
| 2978 | SCNN1B | 3652927 | CAGGTGCCACAGCAGGAGCTAGTAGAGATGAGCTACCCCGGCGAGCAGATGATCCTGGCCT GCCTATTCGGAGCTGAGCCCTGCAAC |
| 2979 | SCNN1B | 3652931 | ACTTCACGTCCATCTTCTACCCTCACTATGGCAACTGTTACATCTTCAACTGGGGCATGACAGA GAAGGCACTTCCTTCGGCCAACC |
| 2980 | SCNN1B | 3652933 | TTCCTTGCGTCCACGGCCGGGGTCAGGCTGATGCTTCACGAGCAGAGGTCATACCCCTTCATC AGAGATGAGGGCATCTACGCCATGTCGGGGACAGAGACGTCCATC |

TABLE 13-continued

Subtyping Target Sequences

| SEQ ID NO. | Gene | Affy Probeset ID | Sequence |
|---|---|---|---|
| 2981 | SCNN1B | 3652934 | CAAGCTTCAGCGCATGGGGGAGCCCTACAGCCCGTGCACCGTGAATGGTTCTGAGGTCCCCG TCCAAAACTTCTACAGTGACTACAACACGACCTACTCCAT |
| 2982 | SCNN1B | 3652935 | GCCAAGGCCTCAGTACTCCGGGAGAGCTGGCCCCAGCAAGTCTGGCTCTGCTGGGCCTTTGT AGGTTGCCACGGGGCACCCCGGGCCTGTGGGACCAGTCACTTTCCTGGGCTCTCTCACCAGG GCCTAGGGTTGGCCACTTCTCATCCCCACATTGGCAGGTGTACCCCTGGGGAAGCCCAGGGG ATTATGGGGATCTTACTCTGGGGTTTC |
| 2983 | SCNN1B | 3652938 | TGCTTCCAAGACCACATGATCCGTAACTGCAACTGTGGCCACTACCTGTACCCACTGCCCCGT GGGGAGAAATACTGCAACAACCGGGACTTCCCA |
| 2984 | SCNN1B | 3652940 | ATGAGCGTGGCGCAGAGAGAGACCTGCATTGGCATGTGCAAG |
| 2985 | SCNN1B | 3652944 | GAAGGGAATTGTCAAGCTCAACATCTACTTCCAAGAATTTAACTA |
| 2986 | SCNN1B | 3652945 | GGCTGCTCTCGAATCTGGGTGGCCAGTTTGGCTTCTGGATGGGGGGCTCTGTGCTGTGCCTC ATCGAGTTTGGGGAGATCATCATCGACTTTGTGTGGATCACCATCATCAAGCTGGTGGCCTTG GCCAAGAGCCTACGGCAGCGGC |
| 2987 | SCNN1B | 3652946 | GCCAAGACTGTTGCCCGAGGCCTCACTGTATGGTGCCCTCTCCAAAGGGTCGGGAGGGTAGC TCTCCAGGCCAGAGCTTGTGTCCTTCAACAGAGAGGCCAGCGGCAACTGGTCCGTTACTGGC CAAGGGCTCTGTAGAATCACGGTGCTGGTACAGGATGCAGGAATAAATTGTATCTTCACCTG GTTCCTACCCTCGTCCCTACCTGTCCTGATCCTGGTCCTGAAGACCCCTCGGAACACCCTCTCCT GGTGGCAGGCCACTTCCCTCCCAGTGCCAGTCTCCATCCACCCCAGAGAGGAACAGGCGGGT GGGCCATGTGGTTTTCTCCTTCCTGGCCTTGGCTGGCCTCTGGGCAGGGGTGGTGGAGAGA TGGAAGGGCATCAGGTGTAGGGACCCTGCCAAGTGGCACCTGATTTACTCTA |
| 2988 | SCNN1B | 3652948 | TAGCTGGCTGATGGGCCACTAAAACCCCCAAATATTGGCCACATAACTTCTGCCATGTGCGAG GGGTAGGGGGTAAGTGTAATGAAAGGGTCAAGGCTTGGGGTCTGGGGTTAGACCACCTAGA CTCAAATCCTGGCTCCATCTTACAAGCTGTGTG |
| 2989 | SCNN1B | 3652949 | TTATAGTTGCTGTAACCTGCCCAGAGAGGTTAAGTAACATCTCTGAAGTCACACAGTTGGTGA GTGGCAGAGCTAGCAGTCTGGGCCAGGCCCACCCCGCATCACTCTATTGCCTCA |
| 2990 | MMP2 | 3661686 | GCAAGCCAGATAGCTACAGTAATCGACAGACAGACAAACAAGAGCATCGTATGACCCAGGG GCCAACAAGTCCCACCCCAGTGACACCATCTCACTTTTGCAGAGCTCTTGCTCGCAAAGTGCA GCTAGGAGAACCCAGGCCTCCTGATGACAAATGCTCCTTCTTTTCTGCCCCCCACGTGCCAAGA GCGAGGAGGGAAGATAGCTGCTGGCTCACTG |
| 2991 | MMP2 | 3661687 | CTTGTTTCCGCTGCATCCAGACTTCCTCAGGCGGTGGCTGGAGGCTGCGCATCTGGGGCTTTA AACATACAAAGGGATTGCCAGGACCTGCGGCGGCGGCGGCGGCGGGGGCTGGGGCGC GGGGGCCGGACCATGAGCCGCTGAGCCGGGCAAACCCCAGGCCACCGAGCCAGCGGACCCT |
| 2992 | MMP2 | 3661688 | ACGGGTCCCCTGAGGGCGCTCTGTCTCCTGGGCTGCCTGCTGAGCCACGCCGCCGCGCGCC GTCGCCCATCATCAAGTTCCCCGGCGATGTCGCCCCCAAAACGGACA |
| 2993 | MMP2 | 3661691 | GCTGAAGGACACACTAAAGAAGATGCAGAAGTTCTTTGGACTGCCCCAGACAGGTGATCTTG ACCAGAATACCATCGAGACCATGCGGAAGCCACGCTGCGGCAA |
| 2994 | MMP2 | 3661694 | AGCATGGCGATGGATACCCCTTTGACGGTAAGGACGGACTCCTGGCTCATG |
| 2995 | MMP2 | 3661695 | GGAGACTCCCATTTTGATGACGATGAGCTATGGACCTTGGGA |
| 2996 | MMP2 | 3661697 | CCGATGGGGAGTACTGCAAGTTCCCCTTCTTGTTCAATGGCAAGGAGTACAACAGCTGCACTG ATACCGGCCGCAGCGATGGCTTCCTCTGGTGCTCCACCACCTACAACTTTGAGAAGGATGGCA AGTACGGCTTCTGTCCC |
| 2997 | MMP2 | 3661698 | CCGGTAGGGATTACATGTGGCGTTAACCCTTCCCTGTGTCACCCCTCTGATAGGAACAGAAAG CTTTGGTGATAGTTAGATGTGGAAACAGCTGTATTTCATAAATTTGGGAAGGGTTATTCCCTG CATTGGACATTAGCCATTTACTTTGTGCTTAGCCAGATGCAGATACGCACAACACGCACGTGT CTGGGTCTCGAGGCAGAGATTGTTGTTACTCAGCCCCTGCTGATGGCTGAGTCAGTGTCTGAT TCTTGCCATCCTTGTCAGGGGAATTTGGGAGGAGACAGGGGCTTCCTGGGTGGTAGAAATGA GAGGTCAGAGGCAGGGGCTGGCATTGGTCGAAGTTAACGCTTTGCCTTTCTCAACTCTGAG GCCACTAAGGTATCTGGACTCAGTCTTGCCTTTTCTCTAGGTGCCATTGTTTCTGGCATTGCAG GACAAGGTCTTTTGGTAGAGAGGGGAGTGGTGAGGATACAGGGCCTCGAGTTCTGTGGTGG GAGGCCAGGGACTGGGCTCATTCCGCCATGGTGGAGTTAACGGGGGCTGGTGAGGTCAC CTCTGGCGCCGTTGTGCACAGATGGTCCTTGTTA |
| 2998 | MMP2 | 3661699 | TGCAAGTTTCCATTCCGCTTCCAGGGCACATCCTATGACAGCTGCACCACTGAGGGCCGCACG GATGGCTACCGCTGGTGCGGCACCACTGAGGACTACGACCGCGA |
| 2999 | MMP2 | 3661700 | GTGGGTGCCACTCCCTCTCCCTCCCTCAGGGCCCAGCACCTGCTGTCTGAC |

TABLE 13-continued

Subtyping Target Sequences

| SEQ ID NO. | Gene | Affy Probeset ID | Sequence |
|---|---|---|---|
| 3000 | MMP2 | 3661701 | TGGGCAACAAATATGAGAGCTGCACCAGCGCCGGCCGCAGTGACGGAAAGATGTGGTGTGC GACCACAGCCAACTACGATGATGACC |
| 3001 | MMP2 | 3661702 | GGTACAGCCTGTTCCTCGTGGCAGCCCACGAGTTTGGCCACGCCATGGGGCTGGAGCACTCC CAAGACCCTGGGGCCCTGATGGCACCCATTTACACCTACACCAAGAACTTCCGTCTGT |
| 3002 | MMP2 | 3661703 | TGTCACTCCTGAGATCTGCAAACAGGACATTGTATTTGATGGCATCGCTCAGATCCGTGGTGA GATCTTCTTCT |
| 3003 | MMP2 | 3661704 | GTGACGCCACGTGACAAGCCCATGGGGCCCCTGCTGGTGGCCACATTCTGGCCTGAGCTCCC GGAAAAGATTGATGCGGTATACGAGGCCC |
| 3004 | MMP2 | 3661705 | CCTGGAGCGAGGGTACCCCAAGCCACTGACCAGCCTGGGACTGCCCCCTGATGTCCAGCGAG TGGATGCC |
| 3005 | MMP2 | 3661707 | CCAAGCTCATCGCAGATGCCTGGAATGCCATCCCCGATAACCTGGATGCCGTCGT |
| 3006 | MMP2 | 3661708 | CTTCTTCAAGGGTGCCTATTACCTGAAGCTGGAGAACCAAAGTCTGAAGAGCGTGAAGTTTG GAAGCATCAAATCCGACTGGCTAGGCTGCTG |
| 3007 | MMP2 | 3661709 | ACTGCCTTCGATACACCGGGCCTGGAGAACTAGAGAAGGACCCGGAGGGGCCTGGCAGCCG TGCCTTCAGCTCTACAGCTAATCAGCATTCTCACTCCTACCTG |
| 3008 | MMP2 | 3661710 | TAGATGCTGACTGTACTCCTCCCAGGCGCCCCTTCCCCCTCCAATCCCACCAACCCTCAGAGCC ACCCTAAAGAGATACTTTGATATTTTCAACGCAGCCCTGCTTTGGGCTGCCCTGGTGCTGCCA CACTTCAGGCTCTTCTCCTTTCACAACCTTCGTGGCTCACAGAACCCTTGGAGCCAATGGAGA CTGTCTCAAGAGGGCACTGGTGGCCCGACAGCCTGGCACAGGGCAGTGGGACAGGGCATGG CCAGGTGGCCACTCCAGACCCCTGGCTTTTCACTGCTGGCTGCCTTAGAACCTTTCTTA |
| 3009 | MMP2 | 3661711 | GTCTGAAGTCACTGCACAGTGCATCTCAGCCCACATAGTGATGGTTCCCCTGTTCACTCTACTT AGCATGTCCCTACCGAGTCTCTTCTCCACTGGATGGAGGAAAACCAAGCCGTGGCTTC |
| 3010 | MMP2 | 3661712 | CCTTCAACCATTCCCCATGGGAAATGTCAACAAG |
| 3011 | MMP2 | 3661713 | AGACCCAGCCAGAAGCGGAAACTTAAAAAGTCCGAATCTCTGCTCCCTGCAGGGCACAGGTG ATGGTGTCTGCTGGAAAGGTCAGAGCTTCCAAAGTAAACAGCAAGAGAACCTCAGGGAGAG TAAGCTCTAGTCCCTCTGTCCTGTAGAAAGAGCCCTGAAGAATCAGCAATTTTGTTGCTTTATT GTGGCATCTGTTCGAGGTTTGCTTCC |
| 3012 | MT1L | 3662135 | GCTCCTGTGCCAGCTCCTGCAAGTGCAAAGAG |
| 3013 | MT1L | 3662136 | TGCAAAGGGGCGTCGGAGAAGTGCAGCTGCTGTG |
| 3014 | MT1L | 3662137 | GTGGGGACAGCCCTGCTCCCAGATGTAA |
| 3015 | MT1L | 3662138 | TTTCATACAACCCTGAGCATTTGCTAC |
| 3016 | MT1E | 3662140 | GACTTCGGGAACACCGCGTACCTGCGGGGGCACAGCCCCACCCGAGCGAACGGGCTCCAAA GGGGAGGTCCCGCGGTGCCCACCGCGCAGAGCTCAGGGGGTGGTGCGCCCGGCCCTTCTGC GGCGCACAGCCCAGCCCAGGAACGCGGGCGGTGCGGACTCAGCGGGCCGGGTGCAGGCGC GGAGCTGGGCCTCTGCGCCCGGCCCGACCTCCGTCTATAAATAGAGCAGCCAGTTGCAGGGC TCCATTCTGCTTTCCAACTGCCTGACTGCTTGTTCGTCTCACTGGTGTGAGC |
| 3017 | MT1E | 3662143 | TGGCTCCTGCACGTGCGCCGGCTCCTGCAAGTGCAAAGAG |
| 3018 | MT1E | 3662145 | CCCTCATTGCCCGTGTCATTCCCTCTCCAGGCTTTCTGCCCTAAATTCAGATGGGGCAGGACA |
| 3019 | MT1E | 3662146 | CAGGGAGGTGCCCGGTCAAGTCTACTGCCACCTCTCACTCTC |
| 3020 | MT1E | 3662147 | CTGCGTCTGCAAAGGGGCATCGGAGAAGT |
| 3021 | MT1E | 3662148 | TGTGGGAACAGCTCTTCTCCCAGAT |
| 3022 | MT1E | 3662149 | TAAATAGAACAACCTGCACAACCTGGATTTTTTTAAAAATACAACACTGAGCCATTTGCTGCAT TTCTTTTTATACTAAATATGTGACTGACAAT |
| 3023 | MT1E | 3662161 | TGGCTCCTGCACGTGCGCCGGCTCCTGCAAGTGCAAAGAG |
| 3024 | CDH1 | 3666410 | AGTGGCGTCGGAACTGCAAAGCACCTGTGAGCTTGCGGAAGTCAGTTCAGACTCCAGCCCGC TCCAGCCCGGCCCGACCCGACCGCACCCGGCGCCTGC |
| 3025 | CDH1 | 3666411 | ATGGGCCCTTGGAGCCGCAGCCTCTCGGCGCTGCTGCTGC |

TABLE 13-continued

Subtyping Target Sequences

| SEQ ID NO. | Gene | Affy Probeset ID | Sequence |
|---|---|---|---|
| 3026 | CDH1 | 3666412 | GCCACCCTGGCTTTGACGCCGAGAGCTACACGTTCACGGTGCCCCGGCGCCACCTGGAGAGAGGCCGCGTCCTG |
| 3027 | CDH1 | 3666418 | CCTGGTTAGTACTAGTACTTGGATG |
| 3028 | CDH1 | 3666427 | GCACCGGTCGACAAAGGACAGCCTATTTTTCCCTCGACACCCGATTCAAAGTGGGCACAGATGGTGTGATTACAGTCAAAAGGCCTCTACGGTTTCATAACCCACAGATCCATTTCTTGGTCTACGCCTGGGACTCCACCTACAGAAAGTTTTCCACCAAAGTCACGCTGAATACAG |
| 3029 | CDH1 | 3666430 | CTGGAATCCAAGCAGAATTGCTCACATTTC |
| 3030 | CDH1 | 3666431 | AAGAGAGACTGGGTTATTCCTCCCATCA |
| 3031 | CDH1 | 3666432 | GAAGGCAAGGTTTTCTACAGCATCACTGGCCAAGGAGCTGACACACCCCTGTTGGTGTCTTTATTATTGAAAGAGAAACAGGATGGCTGAAGGTGACAGAGCCTCTGGATAGAGAACGCATTGCC |
| 3032 | CDH1 | 3666433 | CTCACGCTGTGTCATCCAACGGGAATGCAGTTGAGGATCCAATGGAGATTTTGATCACGGTAACCGATCAGAATGACAACAAGCCCGAATTCACCCAGG |
| 3033 | CDH1 | 3666435 | AGACGCGGACGATGATGTGAACACCTACAATGCCGCCATCGCTTACACCATCCTCAGCCAAGATC |
| 3034 | CDH1 | 3666436 | CTGACTTGGTTGTGTCGATCTCTCTGCAG |
| 3035 | CDH1 | 3666437 | CCTTCAAGGTGAGGGGTTAAGCACAACAGCAACAGCTGTGATCACAGTCACTGACACCAACGATAATCCTCCGATCTTCAATCCCA |
| 3036 | CDH1 | 3666438 | CGTCGTAATCACCACACTGAAAGTGACTGATGCTGATGCCCCCAATACCCCAGCGTGGGAGGCTGTATACACCATATTGAATGATGATGGTGGACAATTTGTCGTCACCACAAATCCAGTGAACAACGATGGCATTTTG |
| 3037 | CDH1 | 3666439 | CTCACAGCTGTTCATACCCTTGTCCCC |
| 3038 | CDH1 | 3666442 | TTTGAGGCCAAGCAGCAGTACATTCTACACGTAGCAGTGACGAATGTGGTACCTTTTGAGGTCTCTCTCACCACCTTCCACAGCCACCGTCACCGGGATGTGCTGGATGTGAATGAAGCCCCCATCTTTGTGCCTCCTGAAAAGAGAGTGGAAGTGTCCGAGGACTTTGGCGTGGGCCAGGAAATCACATCCTA |
| 3039 | CDH1 | 3666444 | CTGGCTGGAGATTAATCCGGACACTGGTGCCATTTCCACTCGGGCTGAGCTGGACAGGGAGGATTTTGAGCACGTGAAGAACAGCACGTACACAGC |
| 3040 | CDH1 | 3666445 | GTTGCTACTGGAACAGGGACACTTCTGCTGATCCTGTCTGATGTGAATGACAACGCCCCCATACCAGAACCTCGAACTATATTCTTCTGTGAGAGGAATCCAAAGCCTCAGGTCATAAACATCATTGATGCAGACCTTCCTCCCAATACATCTCCCTTCACAGCAGAACTAACACACGGGGCGAGTGCCAACTGGACCATTCA |
| 3041 | CDH1 | 3666447 | ACTATTCTACCGAGGTGGAGGCAGCTGTCAACTGCCTGGTCAATTTGCATATATGGGCTTCCTACACCTACTTCTCTCTGGGCTTCTATTTCCACCATGACGATGTGGATCTGGAAGGTGTGCACCACTTCTTCCACAAATTGGCCAAGGAGAAGCACAAGGGCGCTGAGTGTCCCTTGAAAATGCAAAACCAGTGTGGCGGCCGCACTGTCTTCCCGGACATCCAGAAGCCATGTAAAGATGAATGGGGTAAAACCCTGGGTGCGATGGAAGTCACTCTGGCCCTGGAGAAGAACCTGAACTGGACCCTTTTGGATCTTC |
| 3042 | CDH1 | 3666450 | CCCAAGAATCTATCATTTTGAAGCCAAAG |
| 3043 | CDH1 | 3666451 | GGTGGGTGACTACAAAATCAATCTCAAGCTCATGGATAACCAGAATAAAGACCAAGTGACCACCTTAGAGGTCAGCGTGTGTGACTGTGAAGGGGCCGCTGGCGTCTGTAGGAAGGCACAGCCTGTC |
| 3044 | CDH1 | 3666452 | TCTTGCTGTTTCTTCGGAGGAGAGCGGTGGTCAAAGAGCCCTTACTGCCCCAGAGGATGACACCCGGGACAACGTTATTACTATGATGAAGA |
| 3045 | CDH1 | 3666453 | ACGCTCGGCCTGAAGTGACTCGTAACGACGTTGCACCAACCCTCATGAGTGTCCCCCGGTATCTTCCCCGCCCTGCCAATCCCGATGAAATTGGAAATT |
| 3046 | CDH1 | 3666454 | CCCGCCTTATGATTCTCTGCTCGTGTTTGACTATGAAGGAAGCGGTTCCGAAGCTGCTAGTCTGAGCTCCCTGAACTCCTCAGAGTCAGACAAAGACCAGGACTATGACTACTTGAACGAATGGGGCAATCGCTTCAAGAAGC |
| 3047 | CDH1 | 3666455 | TCCCTTCCCTTGAGATGAGTTTCTGGGGAAAAAAAGAGACTGGTTAGTGATGCAGTTAGTATAGCTTTATACTCTCTCCACTTTATAGCTCTAATAAGTTTGTGTTAGAAAAGTTTCGACTTATTTCTTAAAGCTTTTTTTTTTTCCCATCACTCTTTACATGGTGGTGATGTCCAAAAGATACCCAAATTTTAATATTCCAGAAGAACAACTTTAGCATCAGAAGGTTCACCCAGCACCTTGCAGATTTTCTTA |

TABLE 13-continued

Subtyping Target Sequences

| SEQ ID NO. | Gene | Affy Probeset ID | Sequence |
|---|---|---|---|
| | | | AGGAATTTTGTCTCACTTTTAAAAAGAAGGGGAGAAGTCAGCTACTCTAGTTCTGTTGTTTTGT<br>GTATATAATTTTTTAAAAAAAATTTGTGTGCTTCTGCTCATTACTACACTGGTGTGTCCCTCTGC<br>CTTTTTTTTTTTTTAAGACAGGGTCTCATTCTATCGGCCAGGCTGGAGTGCAGTGGTGCAATC<br>ACAGCTCACTGCAGCCTTGTCCTCCCAGGCTCAAGCTATCCTTGCACCTCAGCCTCCCAAGTAG<br>CTGGGACCACAGGCATGCACCACTACGCATGACTAATTTTTTAAATATTTGAGACGGGGTCTC<br>CCTGTGTTACCCAGGCTGGTCTCAAACTCCTGGGCTCAAGTGATCCTCCCATCTTGGCCTCCCA<br>GAGTATTGGGATTACAGACATGAGCCACTGCACCTGCCCAGCTCCCCAACTCCCTGCCATTTTT<br>TAAGAGACAGTTTCGCTCCATCGCCCAGGCCTGGGATGCAGTGATGTGATCATAGCTCACTGT<br>AACCTCAAACTCTGGGGCTCAAGCAGTTCTCCCACCAGCCTCCTTTTTATTTTTTTGTACAGATG<br>GGGTCTTGCTATGTTGCCCAAGCTGGTCTTAAACTCCTGGCCTCAAGCAATCCTTCTGCCTTGG<br>CCCCCCAAAGTGCTGGGATTGTGGGCATGAGCTGCTGTGCCCAGCCTCCATGTTTTAATATCA<br>ACTCTCACTCCTGAATTCAGTTGCTTTGCCCAAGATAGGAGTTCTCTGATGCAGAAATTATTGG<br>GCTCTTTTAGGGTAAGAAGTTTGTGTCTTTGTCTGGCCACATCTTGACTAGGTATTGTCTACTC<br>TGAAGACCTTTAATGGCTTCCCTCTTTCATCTCCTGAGTATGTAACTTGCAATGGGCAGCTATC<br>CAGTGACTTGTTC |
| 3048 | MYH11 | 3682029 | TCTACAGTTTTGCACCACGGCAAGAAAACCAAAAACCAAAACAAACAAACAAAAAAAACCCA<br>ACAACAACCCAGAACAAAGCAAACCCAGCAGACTGTACTTAGCATTGTCTAAATCCATTCTC<br>AAATTCCAAATATCACAGACACCCCTCACACAAGGAATATAAAAACCACCACCCTCCAGCCTG<br>GGCAACGTAGTAAAACCTCATCTATACAAGAATTTAAAAATAAGCTGGGCGTGGTGGTACAC<br>ACCTGTGGTCCCAGCTACTAGGGAGGCTGAGCCAGGAAGAACGCTCCAGCCCAGGACTTCGA<br>GGCTGCAATGAGCTATAATTGCATCATTGCACTCCAGCCTGGGCAACAGAGACCCTGTCTCAA<br>CCACCACCACCACCACCCCCTACTACCCCTGTATTCAAGGTAAAAATTGAAGTTTGTATGAT<br>GTAAGAGATGAGAAAAACCCAACAGGAAACAGACACATCCTCCAGTTCTATCAATGGATT<br>GTGCAGACACTGAGTTTTTAGAAAAACATATCCACGGTAACCGGTCCCTGGCAATTCTGTTTA<br>CATGAAATGGGGAGAAAGTCACCGAAATGGGTGCCGCCGGCCCCACTCCCAATTCATTCCC<br>TAACCTGCAAACCTTTCCAACTTCTCACGTCAGGCTTTGAGAATTCTTTCCCCCTCTCCTGGTT<br>TCCACACCTCAGACACGCACAGTTCACCAAGTGCCTTCTGTAGTCACATGAATTGAAAAGGAG<br>ACGCTGCTCCCACGGAGGGGAGCAGGAATGCTGCACTGTTTACACCCTGACTG |
| 3049 | MYH11 | 3682030 | AAGGTCTGGAGGACGTAGAGTTATTGAAAATGCAGATGGTTCTGAGGAGGAAACGGACACT<br>CGAGACGCAGACTTCAATGGAACCAAGGC |
| 3050 | MYH11 | 3682031 | ACGAGACCTCTTTCGTTCCTTCTAG |
| 3051 | MYH11 | 3682032 | CCCCCCCACAGGAAACTTCGCAGTGA |
| 3052 | MYH11 | 3682034 | GGAGGAGTCCCAGCGCATCAACGCCAACCGCAGGAAGCTGCAGCGGGAGCTGGATGAGGCC<br>ACGGAGAGCAACGAGGCCATGGGCCGCGAGGTGAACGCACTCAAGAGC |
| 3053 | MYH11 | 3682035 | GGCGGCCACCAAGTCGCTGAAGCAGAAAGACAAGAAGCTGAAGGAAATCTTGCTGCAGGTG<br>GAGGACGAGCGCAAGATGGCCGAGCAGTACAAG |
| 3054 | MYH11 | 3682037 | GCAACGAGCTGGCCACAGAGCGCAGCACGGCCCAGAAGAATGAGAGTGCCCGGCAGCAGCT<br>CGAGCGGCAGAACAAGGAGCTCCGGAGCAAGCTCCACGAGATGGAGGGGGCCGTCAAGTCC<br>AAGTTCAAGTCCACCATCGCGGCGCTGG |
| 3055 | MYH11 | 3682038 | AGCTCTGACCTTATCCAGTGAGCCCTTGGTGATGTCACTGAGCACTAGTTCCATG |
| 3056 | MYH11 | 3682039 | GTGCAGGCCCTGGATTGAGGGACAAGAGGGTG |
| 3057 | MYH11 | 3682040 | AGGATCCTGCACCAGTCAACACACGCGTGGCGGCTTCCT |
| 3058 | MYH11 | 3682041 | AGGCCATGAGCGACCGGGTCCGCAAAGCCACACAGCA |
| 3059 | MYH11 | 3682042 | GAACGCACTCCAGGACGAGAAGCGCCG |
| 3060 | MYH11 | 3682043 | CCGCTGAGAGGGCTCGCAAACAAGCGGACCTCGAGAAGGAGGAACT |
| 3061 | MYH11 | 3682044 | GGAAGATGCCCGTGCCTCCAGAGATGAGATCTTTGCC |
| 3062 | MYH11 | 3682045 | GAGCTTCAGGCCGACTCTGCCATCAAGGGGAGGAGGAAGCCATCAAGCAGCTACGCAAAC<br>TGCAG |
| 3063 | MYH11 | 3682047 | GCCAAACTGCGGCTGGAAGTCAACATGCAGGCGCTCAAGGGCCAGTTCGAAAGGGATCTCC<br>AAGCCCGGGACGAGCAGAATG |
| 3064 | MYH11 | 3682048 | TTGAGCCTCATAGAATGGGGCTGCCCGCTCT |
| 3065 | MYH11 | 3682049 | TCTCTTCCAAATACGCGGATGAGAGGGACAGAGCTGAGGCAGAAGCCAGGGAGAAGGAAAC<br>CAAGGCCCTGTCCCTGGCTCGGGCCCTTGAAGAGGCCTTGGAAGCCAAAGAGGAACTCGAGC<br>GGACCAACAAAATGCTCAAAGCCGAAATGGAAGACCTGGTCAGCTCCAAGGATGACGTGGG<br>CA |

TABLE 13-continued

Subtyping Target Sequences

| SEQ ID NO. | Gene | Affy Probeset ID | Sequence |
|---|---|---|---|
| 3066 | MYH11 | 3682050 | TTGCCAGCACCGTGGAAGCTCTGGAAGAGGGGAAGAAGAGGTTCCAGAAGGAGATCGAGA<br>ACCTCACCCAGCAGTACGAGGAGAAGGCGGCCGCTTATGATAAACTGGAAAAGACCAAGAA<br>CAGGCTTCAGCAGGAGCTGGACGACCTGGTTGTTGATTTGGACAACCAGCGGCAACTCGTG |
| 3067 | MYH11 | 3682052 | TGCTTCAAGAAGAAACCCGGCAGAAGCTCAACGTGTCTACGAAGCTGCGCCAG |
| 3068 | MYH11 | 3682054 | TGAGAGCGTCACAGGGATGCTTAACGAGGCCGAGGGGAAGGCCATTAAGCTGGCCAAGGAC<br>GTGGCGTCCCTCAGTTC |
| 3069 | MYH11 | 3682055 | TGAACACCTCAAGTACTAGCCCATGTGTTTTGAGTAAAAAGGGCTCCTTTCAACGAGGATCCC<br>CTTCTAGAGGCTTTGACTAACCAGTCTCTTGGCACCCTTAG |
| 3070 | MYH11 | 3682062 | AGGTGACGGTGCTGAAGAAGGCCCTGGATGAAGAGACGCGGTCCCATGAGGCTCAGGTCCA<br>GGAGATGAGGCAGAAACACGCACAGGCGGT |
| 3071 | MYH11 | 3682066 | AAAGCAGAAGCGAGACCTCGGCGAGGAGCTGGAGGCCCTAAAGACAGAGCTGGAA |
| 3072 | MYH11 | 3682068 | GCTGAAACGGAAGCTGGAGGGTGATGCCAGCGACTTCCACGAGCAGATCGCTGACCTCCAG<br>GCGCAGATCGCAGAGCTC |
| 3073 | MYH11 | 3682069 | GAAAAGGCCAAGAATCTTACCAAGCTGAAAA |
| 3074 | MYH11 | 3682070 | CTCCTTGAGGAGAGGATTAGTGACTTAACGACAAATCTTGCAGAAG |
| 3075 | MYH11 | 3682071 | CTGCAACTTGAGAAGGTCACGGCTGAGGCCAAGATCAAG |
| 3076 | MYH11 | 3682072 | GGAGAAGAACCTGCTACAGGAACAGCTGCAGGCAGAGACAGAGCTGTATGCAGAGGCTGAG<br>GAGATGCGGGTGCGGCTGGCGGCCAAGAAGCAGGAGCTGGAGGAGATACTGCATGAGATG<br>GAGGCCCGCCTGGAGGAGGAGGAAGACAGGGGCCAGCAGCTACAGGCTGAAAGGAAG |
| 3077 | MYH11 | 3682074 | GAGAATGAGCTTAAGGAGCTGGAACAG |
| 3078 | MYH11 | 3682076 | GCAGCTGACCGCCATGAAGGTGATTCAGAGGAACTGCGCCGCCTACCT |
| 3079 | MYH11 | 3682078 | AGCAAAATCTTCTTCCGAACTGGCGTCCTGGCCCACCTAGAGGAGGAGCGAGATTTGAAGAT<br>CACCGATGTCATCATGGCCTTCCAGGCGATGTGTCGTGGCTACT |
| 3080 | MYH11 | 3682080 | CAAGCTGGATGCGTTCCTGGTGCTGGAGCAGCTGCGGTGCAATGGGGTGCTGGAAGGCATT<br>CGCATCTGCCGGCAGG |
| 3081 | MYH11 | 3682081 | AGGAAGTATTCACTGGGCTCTGCCCTGTCCTGGGTGCTGGGGAGCAGTGTTAGAAAAATTGT<br>AGCCCTTCCCTGTGGGTTTCTCATAATCTGGTGCAGGCATCTTCAGCTTGGGGCGATTGTGTC<br>CTCTATATGGACATGCTACAGACATTTTTGGTTGTCACAACCAGGAGGGGGCTGTTAGTCAGC<br>ATCTAGTGGGTAGGGGCCAGGGATGCCCTAAGCATTGTACA |
| 3082 | MYH11 | 3682082 | CCTGGACCAGATGGCCAAGATGACGGAGAGCTCGCTGCCCAGCGCCTCCAAGACCAAGAAG<br>GGCATGTTCCGCACAGTGGGGCAGCTGTACAAGGAGCAGCTGGGCAAGCTGATGACCACGC<br>TACGCAACACCACGCCCAACTTC |
| 3083 | MYH11 | 3682083 | CTATAATGCGAGTGCCTGGCTGACCAAGAATATGGACCCGCTGAATGACAACGTGACTTCCCT<br>GCTCAATGCCTCCTCCGACAAGTTT |
| 3084 | MYH11 | 3682084 | ACGGACAAGTCTTTCGTGGAGAAGCTGTGCACGGAGCAGGGCAGCCACCCCAAGTTCCAGA<br>AGCCCAAGCAGCTCAAGGACAAGACTGAGTTCTCCATCATCCATTATGC |
| 3085 | MYH11 | 3682086 | GGCTGGACCTACAGCCCTGCATCGAG |
| 3086 | MYH11 | 3682091 | TTTGGCCAAGGCAACATATGAGCGCCTTTTCCGCTGGATACTCACCCGCGTGAACAAAGCCCT<br>GGACAAGACCCATCGGCAAGGGGCTTCCTTCCTGGGGATCCTGGATATAGCTGGATTT |
| 3087 | MYH11 | 3682092 | TGCTCAGAAAGTTTGCCACCTCATGGGAATTAATGTGACAGATTTCACCAGATCCATCCTCACT<br>CCTCGTATCAAGGTTGGGCGAGATGT |
| 3088 | MYH11 | 3682094 | TGAAGGTGGTATCATCGGTCCTGCAGCTT |
| 3089 | MYH11 | 3682099 | GGAGGGCTTCAACAACTACACCTTCCTCTCCAATGGCTTTGTGCCCATCCCAGCAGCCCAGGA<br>TGATGAGATGTTCCAGGAAACCGTGGAGGCCATGGCAATCATGGGTTTCAGCGAGGAGGA |
| 3090 | MYH11 | 3682103 | CTGCTAGAAAAATCACGGGCAATTCGCCAAGCCAGAGAC |
| 3091 | MYH11 | 3682107 | CATCCGCATCAACTTCGACGTCACGG |
| 3092 | MYH11 | 3682109 | AAGCAGCTTCTACAAGCAAACCCGATTCTGGAGGCTTTCGGCAACGCCAAAACAGTGAAGAA<br>CGACAACTCCTCA |

TABLE 13-continued

Subtyping Target Sequences

| SEQ ID NO. | Gene | Affy Probeset ID | Sequence |
|---|---|---|---|
| 3093 | MYH11 | 3682110 | GGCCCAACTGCAGCCGCCATGTTTTAGGGCTAGGCCAAGAGCAGCTCGTTTGCTTTCCCAGCT TAACTTACCACATTGGCCCTTTCCTGCCATGATTAATCACGTGACCGCGTTTGTGCAAAGGCAT CCCGGCAGAGGGGGCCGGTGGGCTGTGTACAGTCTCAGCTTCCTTTAACCCAATGAATGGAG CTCAGGCAACCTGCTTTGAAGCTTTATTCCGCAGTCCGCTAAGAGGATTCCTGGTGGGTTTTG TGCATTCCTTACTTGTCTGCTGTAGAAGACTTCAGAAAACCAGTCCTGAGAAAGAAAAAATTG CAACTTAAAAAAAATTGCACTAAAATAATTAGAAGGAGGCTTGTAGTGGTTTAACTTGAAGAA GGCTGCTTGTTAAACATGAACAGCAGCACGACTGCCATGTACAGTGGGACAGGTGGTGCACT GCACAACTCCGGGGGGCACCATTCATCATGATGTAAATGACATCACCGACATTGTGCAAGGC AGTGGCTTTGAGTGGCAGTGATGTTGCACAGATGAGCAGGCCCTGGTCTTGAAAAAGTGAC CTTCCTAGGGAGCAGATGTCCTAGCTATTAGAGAGCTCAGACAGTTGCTTCTCTTCTGAAATC CTCCTGTAAATCTGAACATTAGCATCAGGGTCTAAGAGGAGGTAGGAGATAGGAGAGAACCT GTGGGTTAAGGGCAGAGTTTTGTGACAACATCCATCCAAGGTAGAACTGTCAGGACCTAGGT TGCTTTCTC |
| 3094 | MYH11 | 3682111 | TCCAGTGTTCGCCATTCCAGATGTCACTTTGCGTCCTCAGAGGGGACTCTGGGGCAGCCACCA TGGCCGGCTTGTCTGGAGGCCCTTGGAGATCTAGGATGGGCGCTGGTCGTGGCTTTGGAGAA CTTTCCTTCTCCAAACAAATGCAGGAAACTCAAGATTCAGCATCCTAGAATTGTCTCTGGCAAG TTGGTTTCCAGCCATAGTGAGTGGGAACAATGGCCCCAGAGGCTGTGTGGCAGTTTAAACAC AGTTTCCACTGCCTTCCCTTTCCCTAAAGAGTAAACACAGGAGATAATACTTTCTAACAACTCA TCGTTATCAAGGGCCTACTATGTGCTGCTTGTTTTGGCTGCATGCGTAAACACATCTC |
| 3095 | MYH11 | 3682112 | CAGCTTGCAGCCCAACCGAGATACAAACAGAACATCATTGCAAGAACTCAGGCCCCATCTGAC TACCCCTCCCCTGAAGACTCAAAGAGGGACCGTCTTTTTGGCGAGCAGGCCTGTTGAGTGTG GGTGATTTCTTGGCTCAGCTAGAAGCATCCCTCCAGAAGGGGGCCCGTTTTGTGAAATGAGA ATAAGCCCTTTCCTTCCATAGCGAGATCTTCCTCCACGTCGGG |
| 3096 | MYH11 | 3682113 | AGGTCATTCAGTACCTGGCCGTGGTGGCCTCCTCCCACAAGGGCAAGAAAGA |
| 3097 | MYH11 | 3682117 | TAAGGTCACCCAGGTAACTGGCAGAGGAGGGATTTGAACTTGAGCAACCTGGTCCTGGAGCC CATTATGCTATTCTGCCAATTGATGCTATAGGGGAGAGAGGCGTTGCTTCTGCCTGGGGTTTT GCAGGACGTGTAGGAGTTGTACAGTACAAAATGCCAGGGTGCTTTGCCAGTCA |
| 3098 | MYH11 | 3682122 | GCCTCTTCTGCGTGGTGGTCAACCCCTATAAACACCTGCCCATCTACTCGGAGAAGATCGTCG ACATGTACAAGGGCAAGAAGAGGCACGAGATGCCGCCTCACATCTACGCCATCGCAGACACG GCCTACCGGAGCATGCTTCAA |
| 3099 | MYH11 | 3682129 | CGCAGAAGGGCCAACTCAGTGACGATGAGAAGTTCCTCTTTGTGGACAAAAACTTCATCAAC AGCCCAGTGGCCCAGGCTGACTGGGCCGCCAAGAGACTCGTCTGGGTCCCCTCGGAGAAGC AGGGCTTCGAGGCAGCCAGCATTAAGGAGGAGAAGGGGGATGAGGTGGTTGTGGAGCTGG TGGAGAATGGCAAGAAGGTCACGGTTGGGAAAGATGACATCCAGAAGATGAACCCCACCCAA GTTCTCCAAGGTGGAGGACATGGCGGAGCTGACGTGCCTCAACGAAGCCTCCGTGCTACACA ACCTGAGGGAGCGGTACTTCTC |
| 3100 | MYH11 | 3682131 | GTCAGATCCGAGCTCGCCATCCAGTTTCCTCTCCACTAGTCCCCCCAGTTGGAGATCT |
| 3101 | TOX3 | 3691696 | TGGACTGTATTTTGATGCAACAACAAAG |
| 3102 | TOX3 | 3691698 | ACGTCCTCTCAAGTGTCTATTAGATAGGCAATAAGAACTGCAGTGTAGCTGAGTAACATCTT TTAGCTGACTATAAATCACTTTGTTTTTAAACAAGAAAAGCTGTGCTCTTTTATGTGATGCCTTT TTTATTTATTCAGGCTATACCTACAATATGTGAATCAAACTGTTTAATGAATCCTGGGACATAC TGATGACTATAAACTGGCCTCTCTGAGTCATAGAAAAATGCCTTATTTCTCCAGAAGTGAGT AAACCACACTTCCAGGCTATCTGAACTCCTGAAGCCCTAAAAATAAAAAGCACAGTTGTAACT ACCTGAAATATGAAGATCCAGTTTCATACAAACATTTGTATGACGTGAATAGTTGATGGCATT TTTTTGTCATGAAAAAATAATGTAAATCACAGACTTTTGCCAAAGCTCTTATTTTTTTTCCTAA ATCTCTCCAGAAAAAAAATGCAAGTGACTAAATTCAATTATTGACTAATTTCCACTTTTTATCCA TGACTTCTCCAAATCAAACCACAGTATATGTTGTAACAATATCTATGACCACTGTTAGCCCATT ATATTCATTCCAATTAGAAGAAATGTGAATACTATATTCCGTGTTTTGAGTGACAAGTTTC |
| 3103 | TOX3 | 3691700 | CCATCCCTGCCATCGGGAGCCCCCAGCCAGCCTCTCAGCAGCACCAGTCGCAAATACAGTCTC AGACACAGACTCAAGTATTATCGCAG |
| 3104 | TOX3 | 3691702 | CACCAGTCTCAGCCTTCTCCTCGGCAG |
| 3105 | TOX3 | 3691704 | AATGCATCAGCAAATCCAGCAGCAGATGCAGCAGCAGCATTTCCAGCACCACATGCAGCAGC ACCTGCAGCAGCAGCAGCAGCATCTCCAGCAGCAAATTAATCAACAGCAGCTGCA |
| 3106 | TOX3 | 3691706 | AGCAGCATCAGATGCAATTGCAGCAGCAGC |
| 3107 | TOX3 | 3691708 | CAGACCATCCGTTCTGTTCAGCAGACCCTGGCGTCGACCAATCTAACATCCTCTCTCCTTCTCA ACACTCCACTGTCTCAACATGGAACAGTGTCAGCATCACCTCAGACTCTCCAGCAATCCCTCCC TAGGTCAATCGCTCCCAAACCCTTAACCATGAGACTCCCCATGAACCAGATTGTCACATCAGTC ACCATTGCAGCCAACATGCCCTCGAACATTGGGGCTCCACTGATAAGCTCCATGGGAACGA |

TABLE 13-continued

Subtyping Target Sequences

| SEQ ID NO. | Gene | Affy Probeset ID | Sequence |
|---|---|---|---|
| 3108 | TOX3 | 3691710 | AAAGAATACCTGAAGGCCCTGGCGGCATACAGGGCCAGCCTCGTTTCTAA |
| 3109 | TOX3 | 3691712 | GTCTCATTATTGTCACCGGGCATTTGAAATTTTATTCCAAGTTCATTTTAAAGCAAGGCAGTAT<br>GAGAGGTATTCAGAAATTAGCCATGCTTGTGGGAGATACTTCCTTAGGGGCTTCGTCTCCTCT<br>CCTTCCCCTTGCAACTCCTCCACACAAATGAAGGGAAGAATGGGTTCCTTGGGGGTCGATCCC<br>CCCCTTACTCCTTGCATGAAACTCCAATTACCATTAAAAGAAGTTAACTTTTACATATCCACAG<br>AAGAATAGATCAACTCCTATGAGTGATAAAATAGAATAATTGTTTTCAAGAATGAAGAGTGG<br>AAAGTCCTTGATTTTGTTTACAAATCATGAACTTATTTCAGGAACTCATTCCTAGAAGCTTGTTT<br>TGTTGGGAAGGTGCAACATTAGAAATTTCTTTTTAGTTTGCACTGAGTTTATTACTGTAGATAG<br>CAGACTGATTTTCTGTCCCAGAAATATAATTCTGAGGGACTGGAAAAGTGCTGCACCTAACTT<br>TTAAACTCTGGAGAGAAAGATGCATGTTGACTGAACACCCAGCCATCAGACCACTTAGGAAA<br>AGGAGAAGCCCAAATCATGTTTAATATGCTGGAATTTTATTTATGTAACTCAGTGGGGTCACT<br>AATGGAAATCTC |
| 3110 | TOX3 | 3691714 | CAGCATATGCCCTGTTTTTCAGAGACACACAGGCTGCAATTAAAGGTCAAAACCCCAATGCAA<br>CCTTTGGAGAGGTCTCAAAAATTGTAGCATCTATGTGGGACAGCCTTGG |
| 3111 | TOX3 | 3691716 | ACACAAGTGTCCCAGTACCGGCAGGATCCCTCCCTGATCATGCGGTCCATCGTCCACATGACC<br>GATGCTGCGCGTTCTGGGGTCATGCCTCCTGCCCAGCTCACCACCATCAACCAGTCTCAGCTC<br>AGCGCCCAGTTGGGGTTGAATTTGGGAGGTGCCAGTATGCCTCACACATC |
| 3112 | TOX3 | 3691718 | CTTTCAAGCCCTCAGCGATCCATTGCCTTCCCAGGGAAGTGAATTCACACCCCAGTTTCCCCCT<br>CAAAGCCTGGACCTCCCTTCCATTACAATCTCAAGAAATCTCGTGGAACAAGATGGCGTGCTT<br>CATAGCAGTGGGTTGCATA |
| 3113 | TOX3 | 3691720 | TGGGGACGAGGAATTCGAAATTCCACCAATCA |
| 3114 | TOX3 | 3691722 | ATGGCTGAGGCGAACAATGCGTTCTTCGCTGCCA |
| 3115 | TOX3 | 3691729 | GCTAGAATCTGTGTTGTTCATTGCAGTTTGTGCTCAGCCACGGAAGGCACCTATCCCTAGCAC<br>CCAACCCCCATCCACCTAGGGCTCTATAAAA |
| 3116 | TOX3 | 3691736 | CTTCGGCATGGATGTGAGGTTCTACCCCGCGGCGGCCGGGGACCCTGCCAGCCTGGACTTCG<br>CGCAGTGCCTGGGGTACTACGGCTACAGCAAG |
| 3117 | TOX3 | 3691738 | CGCGCGCAGCGCTGCCTCGGTGCCCCGGCGGGGCGCGTCCCCCCGGCCGCCTCCCGCTCTCC<br>CGCGGCTCGCGTGGCCGCGCCTTTGTGTGCGGCGGCCGCGGCTCCCGAGCTCCTCGGGCTCT<br>GGGTCCCGGCGCCCCTCCGGCCGCGAGTCCCACGCGCCACCCCCGGGCGCCCTCGACGGTGG<br>ATCTAGCGGC |
| 3118 | NQO1 | 3696673 | CCCTTGCCGTGATAGCTTGCAACACCTTGG |
| 3119 | NQO1 | 3696675 | CTGGCCCTTGCAATCTTCTACTTTAAGGTTTGCAGAGATAAACCAATAAATCCACACCGTACAT<br>CTGCAATATGAATTCAAGAAAGGAAATAGTACCTTCAATACTTAAAAATAGTCTTCCACAAAA<br>AATACTTTATTTCTGATCTATACAAATTTTCAGAAGGTTATTTTCTTTATCATTGCTAAACTGAT<br>GACTTACTATGGGATGGGGTCCAGTCCCATGACCTTGGGGTACAATTGTAAACCTAGAGTTTT<br>ATCAACTTTGGTGAACAGTTTTGGCATAATAGTCAATTTCTACTTCTGGAAGTCATCTCATTCC<br>ACTGTTGGTATTATATAATTCAAGGAGAATATGATAAAACACTGCCCTCTTGTGGTGCATTGA<br>AAGAAGAGATGAGAAATGATGAAAAGGTTGCCTGAAAAATGGGAGACAGCCTCTTACTTGCC<br>AAGAAAATGAAGGGATTGGACCGAGCTGGAAAACCTCCTTTACCAGATGCTGACTGGCACTG<br>GTGGTTTTGCTCTCGACAGTATCC |
| 3120 | NQO1 | 3696676 | GGTACAGTTTGGCTAGGTATCATTCAACTCTCCAATGTTCTATTAATCACCTCTCTGTAGTTTAT<br>GGCAGAAGGGAATTGCTCAGAGAAGGAAAAGACTGAATCTACCTGCCCTAAGGGACTTAACT<br>TGTTTGGTAGTTAGCCATCTAATGCTTGTTTATGATATTTCTTGCTTTCAATTACAAAGCAGTTA<br>CTAATATGCCTAGCACAAGTACCACTCTTG |
| 3121 | NQO1 | 3696677 | AACATGTTATCAAATCTGGGTATCTTTCCAGGCTTCCCTGACTTGCTTTAGTTT |
| 3122 | NQO1 | 3696678 | TTTCTGTGGGCCATCACTTGGGCAAGTCCATCCCAACTGACAACCAGATCAAAG |
| 3123 | NQO1 | 3696679 | TGTGGCTTCCAAGTCTTAGAACCTCAACTGACATATAGCATTGGGCACACTCCAGCAGACGCC<br>CGAATTCAAATCCTGG |
| 3124 | NQO1 | 3696681 | GTGCTTTCCATCACCACTGGTGGCAGTGGCTCCATGTACTCTCTGCAAGGGATCCACGGGGAC<br>ATGAATGTCATTCTCTGGCCAATTCAG |
| 3125 | NQO1 | 3696683 | CATTCTGAAAGGCTGGTTTGAGCGAGTGTTCATAGGAGAGTTTGCTTACACTTACGCTGCCAT<br>GTATGACAAAGG |
| 3126 | NQO1 | 3696686 | GACCCTGCGAACTTTCAGTATCCTGCCGAGTCTGTTCTGGCTTATAAAGAAGGCCATCTGAGC<br>CCAGATATTGTGGCTGAACAAAAGAAGCTGGAAGCCGCAGACCTTGTGATATTCCAG |

TABLE 13-continued

Subtyping Target Sequences

| SEQ ID NO. | Gene | Affy Probeset ID | Sequence |
|---|---|---|---|
| 3127 | NQO1 | 3696687 | AGCACTGATCGTACTGGCTCACTCAGAGAGGACGTCCTTCAACTATGCCATGAAGGAGGCTGCTGCAGCGGCTTTGAAGAAGAAAGGATGGGAGGTGGTGGAGTCGGACCTCTATGCCATGAACTTCAAT |
| 3128 | NQO1 | 3696689 | TCAAACGGGCCGGACAGGATATATAAGAGAGAATGCACCGTGCACTACACACGCGACTCCCACAAGGTTGCAGCCGGAGCCGCCCAGCTCACCGAGAGCCTAGTTCCGGCCAGG |
| 3129 | CD68 | 3708859 | CTGGTGCAGACAGCCTAGCTGGACTTTGGGTGAGGCGGTTCAGCC |
| 3130 | CD68 | 3708860 | GGCTGTGCTTTTCTCGGGGGCCCTGCT |
| 3131 | CD68 | 3708861 | TTTGCTGCCATCCTTCACGGTGACACCCACGGTTACAG |
| 3132 | CD68 | 3708862 | TACCAAGAGCCACAAAACCACCACTCACAGGACAACCACCACAGGCACCACCAGCCACGGACCCACGACTGCCACTCACAA |
| 3133 | CD68 | 3708863 | AGCAATAGCACTGCCACCAGCCAGGGACCCTCAACTGCCACTCACAGTCCTGCCACCACTAGTCATGGAAATGCCACGGTTCATCCAACAAGCAACAGCACTGCCACCAGCCCAGGATTCACCAGTTCTG |
| 3134 | CD68 | 3708864 | ACCACCTCCACCCTCTCCGAGTCCTAG |
| 3135 | CD68 | 3708865 | AGGAGACCATTGGAGACTACACGTGGACCAATGGTTCCCAGCCCTGTGTCCACCTCCAAGCCCAGATTCAGATTCGAGTCATGTACACAACCCAGG |
| 3136 | CD68 | 3708867 | TCTCTGTACTGAACCCCAACAAAACCAAGGTCCAGGGAAGCTGTGAGGGTGCCCATCCCCACCTGCTTCTCTCATTCCCCTATGGACAC |
| 3137 | CD68 | 3708868 | AGCTACATGGCGGTGGAGTACAATGTGTCCTTCCCCCA |
| 3138 | CD68 | 3708869 | AGTGGACATTCTCGGCTCAGAATGCATCCCTTCGAGATCTCCAAGCACCCCTGGGGCAGAGCTTCAGTTGCAGCAACTCGAGCATCATTCTTTCACCAGCTGTCCACCTCGACCTGCTCTCCCTG |
| 3139 | CD68 | 3708870 | CCAGGCCCATAAGCCACTCATCTCTCTTCTTAACCCCCCAAATCTCGCTCTCCCAGCTTGTCATGGCTACAGGGCAGCTTTCTTTCCATCCTCTACAAGACTCTGCCAGTTTCCCCCTTTTATCACTGCTGAGTCACTGCGGTGAGCTCCTCACCAATCTCCTACTCCCCAGCATCCCCCCATTCCCTCCTCCCACCTTTATCCCAACCAGCACGTCACTGCAAATACCTACCTG |
| 3140 | CD68 | 3708871 | CAGTGACCGGTCCATCTTGCTGCCTCTCATCATCGGCCTGATCCTTCTTGGCCTCCTCGCCCTGGTGCTTATTGCTTTCTGCATCATCCGGAGACGCCCA |
| 3141 | CD68 | 3708872 | GGTACCCTTATTTCCTCGACACGCAACTGGCTCAAAGACAATGTTATTTTCCTTCCCTTTCTTGAAGAACAAAAGAAAGCCGGGCATGACGGCTCATGCCTGTAATCCCAGCACTTTGGGAGGCTGAGGCAGGTGGATCACTGGAGGTCAGGAGTTTGAGACCAGCCTGGCCAACATGGTGAAACCCTGTCTCTACTAAAAATACAATTAGCCAGGTGTGGCGGCGTAATCCCAGCTGGCCTGTAATCCCAGCTACTTGGGAGGCTGAGGCAGAACTGCTTGAACCCAGGAGGTGGAGGTTGCAGTGAGCCGTCATCGCGCCACTAAGCCAAGATC |
| 3142 | CD68 | 3708873 | TTTTATTAAATGTGACGAACTGCCCCCCCCCCCCCCCCAGCAGGAGAGCAGCAAAATTTATGCAAATCTTTGACGGGGTTTTCCTTGTCCTGCCAGGATTAAAAGCCATGAGTT |
| 3143 | ERBB2 | 3720403 | TTCCCGGATTTTTGTGGGCGCCTGCCCCGCCCCTCGTCCCCCTGCTGTGTCCATATATCGAGGCGATAGGGTTAAGGGAAGGCGGACGCCTGATGGGTTAATGAGCAAACTGAAGTGTTTTCCATGATCTTTT |
| 3144 | ERBB2 | 3720404 | CGCAATTGAAGTACCACCTCCCGAGGGTGATTGCTTCCCCATGCGGGGTAGAACCTTTGC |
| 3145 | ERBB2 | 3720406 | CCAGTGGTCTATACCTCCAGCAGCAAGTCGAGTGAGCAAGTGATGTCCTGAAAGGCCCAGTGGATCAGTGGAATGAAGCGGGCAGGAAGACTTAGTGCTCCTGAAACAAGGAATCCAGAATCCAGGAGAAGGATGGCTCAGTGGGGCTTTCAAGGGACAAGTATGGGGGTTGAAGGGGTCACTGTCCCTATACC |
| 3146 | ERBB2 | 3720407 | GGCAAAGCAAAGCTATATTCAAGACCACATGCAAAGCTACTCCCTGAGCAAAGAGTCACAGATAAAACGGGGGCACCAGTAGAATGGCCAGGACAAACGCAGTGCAGCA |
| 3147 | ERBB2 | 3720408 | GATGAGAGTGACATGTACTGTTGTGGACATGC |
| 3148 | ERBB2 | 3720410 | TGCCCCGGGGGTCCTGGAAGCCACA |
| 3149 | ERBB2 | 3720411 | AGAATGAAGTTGTGAAGCTGAGATTCCCCTCCATTGGGACCGGAGAAACCAGGGGAGCCCCCCGGGCAGCCGCGCGCCCCTTCCCACGGGGCCCTTTACTGCGCCGCG |
| 3150 | ERBB2 | 3720412 | CAGCCGGAGCCATGGGGCCGGAGCCG |

TABLE 13-continued

Subtyping Target Sequences

| SEQ ID NO. | Gene | Affy Probeset ID | Sequence |
|---|---|---|---|
| 3151 | ERBB2 | 3720413 | GAGCTGGCGGCCTTGTGCCGCTGGGGCTCCTCCTCG |
| 3152 | ERBB2 | 3720417 | TGTGCACCGGCACAGACATGAAGCTGCGGCTCCCTGCCAGTCCCGAGACCCACCTGGACATG CTCCGCCACCTCTACCAGGGCTGCCAGGTGGTGCAGGGAAACCTGGAACTCACCTACCTGCCC ACCAATGCCAGCCTGT |
| 3153 | ERBB2 | 3720419 | TTGGGAGCAGTTGTGAAGCTCAGAAGAGAAATGTCTGTGAAAAGGTTATGAACAGGAGGGA GAGTGGAAACCAACCTGCTGGATCGTGTCCACAGACCCTGGAATGGGGCCACATGCTTGGTT TGTCAAATTGCAGACGCCGGCCGGGT |
| 3154 | ERBB2 | 3720420 | CAGGGCTACGTGCTCATCGCTCACAACCAAGTGAGGCAGGTCCCACTGCAGAGGCTGCGGAT TGTGCGAGGCACCCAGCTCTTTGAGGACAACTATGCCCTGGCCGTGCTAGACAATGGAGACC CGCTGAACA |
| 3155 | ERBB2 | 3720421 | AGGGGAAAGGGTCCTCTGATCATTGCTCACCC |
| 3156 | ERBB2 | 3720422 | GGTCTTGATCCAGCGGAACCCCCAGCTCTGCTACCAGGACACGATTTTGTGGAAGGACATCTT CCACAAGAACAACCAGCTGGCTCTCACACTGATAGACACCAACCGCTCTCGGGCC |
| 3157 | ERBB2 | 3720425 | GCCACTGCCCACTGACTGCTGCCATGAGCAGTGTGCTGCCGGCTGCACGGGC |
| 3158 | ERBB2 | 3720427 | TGGTCACCTACAACACAGACACGTTTGAGTCCATGCCCAATCCCGAGGGCCGGTATACATTCG GCGCCAGCTGT |
| 3159 | ERBB2 | 3720428 | ACCTTTCTACGGACGTGGGATCCTGCACCCTCGTCTGCCCCCTGCACAACCAAGAGGTGACAG CAGAGGATGGAACACAGCGGTGTGAGAAGTGCAGCAAGCCCTGT |
| 3160 | ERBB2 | 3720429 | TGCAGTTCCTGTCCCTCTGCGCATGCAGCCTGGCCCAGCCCACCCTGTCCTATCCTTC |
| 3161 | ERBB2 | 3720430 | TACAAGTGTCCCTATATCCCCTGTCAGTGTGGGAGGGGCCCGGACCCTGATGCTCATGTGGC |
| 3162 | ERBB2 | 3720431 | GGCATGGAGCACTTGCGAGAGGTGAGGGCAGTTACCAGTGCCAATATCCAGGAGTTTGCTG GCTGCAAGAAGATCTTTGGGA |
| 3163 | ERBB2 | 3720432 | AACACTGCCCCGCTCCAGCCAGAGCAGCTCCAAGTGTTTGAGACTCTGGAAGAGATC |
| 3164 | ERBB2 | 3720434 | GGCGCCTACTCGCTGACCCTGCAAGGGCTGGGCATCAGCTGGCTGGGGCTGCGCTCACTGAG GGAACTGGGCAGTGGACTGGCCCTCATCCACCATAACACCCACCTCTGCTTCGTGCACACGGT GCCCTGGGACCAGCTCTTTCGGAACCCGCA |
| 3165 | ERBB2 | 3720435 | AGCAGCGTTCTTGGACTTGTGCAGACTGCCCGTCTCTGTGCACCCTTCTTGACTCAGCACAGCT CTGGCTGGCTTGGCCTCTTGGCATGGCTTCTCTAGCTGGGTCCTACCTGCCTTGGCATCCTTCC CTCCCCCTCTGTTTCTGAAATCTCAGAACTCTTCCTCTCCCTACATCGGCCCCACCTGTCCCCAC CCCTCCAGCCCACAGCCATGCCCACAGCCAGTTCCCTGGTTCACTTGGACCTG |
| 3166 | ERBB2 | 3720436 | GCCACCAGCTGTGCGCCCGAGGGCACTGCTGGGGTCCAGGGCCCACCCAGTGTGTCAACTGC AGCCAGTTCCTTCGGGGCCAGGAGTGCGTGGAGGAATGCCGA |
| 3167 | ERBB2 | 3720437 | TGGCTGGAGGGGTGCATGGGGCTCCTCTCAGACCCCCTCACCACTGT |
| 3168 | ERBB2 | 3720438 | GCTCCCCAGGGAGTATGTGAATGCCAGGCACT |
| 3169 | ERBB2 | 3720439 | ACTCGCTGTTACACCTTAGGTAATGCGTTTTCCTCTCTGGGTGCCTCCCATTTTCTGGCTCAAGT CCCTGCCCAGGATCAAGCTTGGAGGAGGGCCCCGAGGGAGGGGCCACAGAGACTGGGTGA AGAGCAAGGGTGTTTGTCCCAGGAGCATGGCGAAAATTGCTGCTGGGTGGCCTTGGGAAGC ACAAAGGGGACCCAACTAAGGGCCTGATCCTACTGCC |
| 3170 | ERBB2 | 3720440 | GTGGCCTGTGCCCACTATAAGGACCCTCCCTTCTGCGTGGCCCGCTGCCCCAGCGGTGTGAAA CCTGACCTCTCCTACATGCCCATCTGGAAGTTTCCAGATGAGGAGGGCGCATGCCA |
| 3171 | ERBB2 | 3720441 | GTGAGTCCAACGGTCTTTTCTGCAGAAAGGAGGACTTTCCTTTCAGGGGTCTTTCTGGGGCTC TTACTATAAAAG |
| 3172 | ERBB2 | 3720442 | GGGCTGCCCCGCCGAGCAGAGAGCC |
| 3173 | ERBB2 | 3720443 | TTCCACTGTGGAACCTCCTGTCATTTTCCACTTCACCAAGTGACAGAGGACCTGCTCAGATGCT GAGGGGAGGGACTGCAAGGAAAGATGGCTAGGAACCCAGTCCCTCCACACCCTAGAGTA ACTTGATGCCTTGTGAGGGACACAGGCAAAGTTCAATTC |
| 3174 | ERBB2 | 3720444 | GTGGTCTTTGGGATCCTCATCAAGCGACGGCAGCAGAAGATCCGGAAGTACACGATGCGGA GACTGCTGCAGG |
| 3175 | ERBB2 | 3720446 | AGCGATGCCCAACCAGGCGCAGATGCGGATCCTGAAAGAGACGGAGCTGAGGAAGGTGAA GGTGCTTGGATCTGGCGCTTT |

TABLE 13-continued

Subtyping Target Sequences

| SEQ ID NO. | Gene | Affy Probeset ID | Sequence |
|---|---|---|---|
| 3176 | ERBB2 | 3720447 | GCATCTGGATCCCTGATGGGGAGAATGTGAAAATTCCAGTGGCCATCAAAGTGTTGAGGGAA AACACATCCCCCAAAGCCAACAAAGAAATCTTAG |
| 3177 | ERBB2 | 3720449 | TGGGCATCTGCCTGACATCCACGGTGCAGCTGGTGACACAGCTTATGCCCTATGGCTGCCTCT TAGACCATGTCCGGGAAAACCGCGGACGCCTGGGCTCCCAGGACCTGCTGAACTGGTGTATG CAGATTGCCA |
| 3178 | ERBB2 | 3720452 | ATGTGCGGCTCGTACACAGGGACTTGGCCGCTCGGAACGTGCTGGTCAAGAGTCCCAACCAT GTCAAAATTACAGACTTCGGGCTGGCTCGGCTGCTGGACATTGACGAGACAGAGTA |
| 3179 | ERBB2 | 3720453 | CTGGGTGGAGTGGTGTCTAGCCCATGGGAGAACTCTG |
| 3180 | ERBB2 | 3720454 | CTGGAGTCCATTCTCCGCCGGCGGTTCACCCACCAGAGTGA |
| 3181 | ERBB2 | 3720455 | ACTGTGTGGGAGCTGATGACTTTTGGGGCCAAACCTTACGATGGGATCCCAGCCCGGGAGAT CCCTGACCTGCTG |
| 3182 | ERBB2 | 3720456 | GTGCGTGGCTGAGCTGTGCTGGCTGCCTGGA |
| 3183 | ERBB2 | 3720457 | GTTGGATGATTGACTCTGAATGTCGGCCAAGATTCCGGG |
| 3184 | ERBB2 | 3720458 | GTTGGTGTCTGAATTCTCCCGCATGGCCAGGGACCCCCAGCGCTTTGTGGT |
| 3185 | ERBB2 | 3720460 | TCTACCGCTCACTGCTGGAGGACGATGACATGGGGGACCTGGTG |
| 3186 | ERBB2 | 3720462 | GTGGGGACCTGACACTAGGGCTGGAGCCCTCTGAAGAGGAGGCCCCCAGGTCTCCACTGGC ACCCTCCGAAGGGGCTGGCTCCGATGTATTTGATGGTGACCTGGGAATGGGGGCAGCCAAG GGGCTGCAAAGCCTCCCCACACATGACCCCAGCCCTCTACAGCGGTACAGTGAGGACCCCAC AGTACCCCTGCCCTCTGAGACTGATGGCTACGTTGCCCCCCCTGA |
| 3187 | ERBB2 | 3720463 | ATGTGAACCAGCCAGATGTTCGGCCCCAGCCC |
| 3188 | ERBB2 | 3720464 | AGCCTTCGACAACCTCTATTACTGGGACCAGGACCCACCAGAGCGGGGGGCTCCACCCAGCA CCTTCAAAGGGACACCTACGGCAGAGAACCCAGAGTACCTGGGTCTGGACGTGCCAGTGT |
| 3189 | ERBB2 | 3720465 | AGAAGGCCAAGTCCGCAGAAGCCCT |
| 3190 | ERBB2 | 3720466 | CGACCACTTCCAGGGGAACCTGCCATGCCAGGAACCTGT |
| 3191 | ERBB2 | 3720467 | CTTCCTGCTTGAGTTCCCAGATGGCTGGAAGGGGTCCAGCCTCGTTGGAAGAGGAACAGCAC TGGGGAGTCTTTGTGGATTCTGAGGCCCTGCCCAATGAGACTCTA |
| 3192 | ERBB2 | 3720468 | GGTACTGAAAGCCTTAGGGAAGCTGGCCTGAGAGGGGAAGCGGCCCTAAGGGAGTGTCTAA GAACAAAAGCGACCCATTCAGAGACTGTCCCTGAAACCTAGTACTGCCC |
| 3193 | ERBB2 | 3720469 | AGTATCCAGGCTTTGTACAGAGTGCTTTTCT |
| 3194 | LRRC37A2 | 3724138 | CACAAGGGGCTTTTTCATCCTTAGGAGACCTGAGTCCTCAAGAAAACCCTTTTCTGGAAGTAT CTGCTCCTTCAGAACATTTTATAGAAAACAATAATACAAAACACACAACTGCAAGAAATGCCT TTGAAGAAAATGATTTTATGGAAAACACTAACATGCCAGAAGGAACCATCTCTGA |
| 3195 | CCL5 | 3753861 | GGCTTACCATTAAAGTTCTCAATGCAACCAT |
| 3196 | CCL5 | 3753862 | TCTGAGGCGCTGCTTTGTCAAAAGGAAGTCTCTAGGTTCTGAGCTCTGGCTTTGCCTTGGCTTT GCCAGGGCTCTGTGACCAGGAAGGAAGTCAGCATGCCTCTAGAGGCAAGGAGGGGAGGAA CACTGCACTCTTAAGCTTC |
| 3197 | CCL5 | 3753863 | AATGGGTTCGGGAGTACATCAACTCTTTGGAGATGAGCTAG |
| 3198 | CCL5 | 3753867 | CTTTGCCTACATTGCCCGCCCACTGCCCCGTGCCCACATCAAGGAGTATTTCTACACCAGTGGC AAGTGCTCCAACCCAG |
| 3199 | CCL5 | 3753868 | ATGAAGGTCTCCGCGGCAGCCCTCGCTGTCATCCTCATTGCTACTGCCCTCTGCGCTCCTGCAT CTGCC |
| 3200 | CCL5 | 3753869 | ATCAAGACAGCACGTGGACCTCGCACAGCCTCTCCC |
| 3201 | KRT23 | 3756592 | GGAAAGTCCTTGCACAGACACCAGTGAGTGAGTTCTAAAAGATACCCTTGGAATTATCAGACT CAGAAACTTTTATTTTTTTTTCTGTAACAGTCTCACCAGACTTCTCATAATGCTCTTAATATATT GCACTTTTCTAATCAAAGTGCGAGTTTATGAGGGTAAAGCTCTACTTTCCTACTGC |
| 3202 | KRT23 | 3756593 | TGAATGAAATCCAAAAGCACGCATGA |

TABLE 13-continued

Subtyping Target Sequences

| SEQ ID NO. | Gene | Affy Probeset ID | Sequence |
|---|---|---|---|
| 3203 | KRT23 | 3756594 | CAGGAGACCATCAACGGAAGATTAGTTCTTTGT |
| 3204 | KRT23 | 3756596 | CACGGGAAGAATCAAAGTCGAGCATGAAAG |
| 3205 | KRT23 | 3756597 | AGTCTCGGTACTCCTGCAAGCTCCAGGACATGCAAGAGATCATCTCCCACTATGAGGAGGAACTGACGCAGCTACGCCATGAACTGGAGCGGCAGAACAATGAATACCAAGTGCTGCTGGGCATCAAAACCCACCTGGAGAAGGAAATCACCACGTACCGACGGCTC |
| 3206 | KRT23 | 3756602 | GGTGACATCCACGAACTGAAGCGCACATTCCAGGCCCTGGA |
| 3207 | KRT23 | 3756603 | CAATGTCAATGTGAAGGTGGATACAGGTCCCAGGGAAGATCTGATTAAGGTCCTGGAGGATATGAGACAAGAATATGAGCTTATAATAAAGAAGAAGCATCGAGACTTGGACACTTGGTATA |
| 3208 | KRT23 | 3756604 | CTTGGAAATTGAAGTCGAGGGCCTCCGAAGGACCTTAGACAACCTGACCATTGTCACAACAGACCTAGAACAGGAGGTGGAAGGAATGAGGAAAGAGCTCATTCTCATGAAGAAGCACCATGAGCA |
| 3209 | KRT23 | 3756605 | CCAGGATGGCAGTGGATGACTTCAACCTCA |
| 3210 | KRT23 | 3756609 | AGGGCTCCCACCGTCCATGGCGGTGCGGGGGAGCCCGCATCTCCCTGTCCTTCACCACGCGGAGCTGCCCACCCCTGGAGGGTCTTGGGGTTCTGGAAGAAGCAGCCCCTACTAGGCGGAAATGGGAAGGCCACCATGCAGAATCTCAACGACCGCCTGGCCTCCTACCTGGAGAAGGTTCGCGCCCTGGAGGAGGCCAACATGAAGCTGGAAAGCCGCATCCTGAAATGGCACCAGCAGAGAGATCCTGGCAGTAAGAAAGATTATTCCCAGTATGAGGAAAACATCACA |
| 3211 | KRT23 | 3756610 | AATACCCGCCTGATGTCGTGGGCCACACCTCCGGGTTACCAGGGGAAGGGAGGAAGCAAACTGTCATATTGATGTGGCTCTAAACAACAACAGTGTGCGAAGGCCCAGGGGCACTTTGGGATTGACCA |
| 3212 | KRT23 | 3756611 | TAAGAGCGAGTCCTTTGAAAGTACTTTCCTTCAAACAGTGACTGCCACAAAGGCATCAGATATTCACCACCTTCTCGGCTGCCTCAGCACAGCAAGCTTTATTCTGGGACCTGAGATCCTGTTC |
| 3213 | KRT23 | 3756612 | TCAACCACATTTGACAGCCCATGGCAGGTTTCCTGTTTTCCATCGTCCCTCTGCAGGTCACAGACACACAGAGCCCAGCCGTGGCAGGCTCAGCCGGGTCCGGGGCTGCTAACAACGGCTACATTCCTCCCCCAGGGCCAAGGGAAATCCTGAGCGCAGGCC |
| 3214 | KRT19 | 3757109 | TCTGCTGTCCTTTGGAGGGTGTCTTCTGGGTAGAGG |
| 3215 | KRT19 | 3757110 | ACAATTTGTCTGCCTCCAAGGTCCTC |
| 3216 | KRT19 | 3757111 | GCCCAGCTGGCGCATATCCAGGCGCTGATCAGCGGTATTGAAGCCCAGCTGGGCGATGTGCGAGCTGATAGTGAGCGGCAGAATCAGGAGTACCAGCGGCTCATGGACATCAAGT |
| 3217 | KRT19 | 3757112 | CCTTGGAAGACACACTGGCAGAAACGGAG |
| 3218 | KRT19 | 3757113 | CGCTTCCCTGTGCAATTCACACTTATACCCTTGCAGCCTAGGGCAGCCTGGCCGGTGGCTGTGCCCATGCCCTCTCCGGGAACCAGGCTCTG |
| 3219 | KRT19 | 3757114 | CAGATGAGCAGGTCCGAGGTTACTGACCTGCGGCGCA |
| 3220 | KRT19 | 3757115 | AGGTGGATTCCGCTCCGGGCACCGATCTCGCCAAGATCCTGAGTGACATGCGAAGCCAATATGAGGTCATGGCCGAGCAGAACCG |
| 3221 | KRT19 | 3757116 | CCTGGGTGTGGGATCATGGATCCCAGGGTTCCAAGAGGAATCAGTGATGACCCAGTCTGTCCCCCAGTGCTAGTTACTAGGCCTGCACCTGAAAACTAAG |
| 3222 | KRT19 | 3757118 | TTTGAGACGGAACAGGCTCTGCGCATGAGCGT |
| 3223 | KRT19 | 3757119 | CCCTCACCTAGCCTAGATGGCCTGAAGCTAACCCCCCTATGGACTCCTGAACTCTGGGGAG |
| 3224 | KRT19 | 3757120 | GAACTCCAGGATTGTCCTGCAGATCGACAAT |
| 3225 | KRT19 | 3757121 | GGAAGAAAGTGAGTGGGCAGTGCCTGTGTGTTGAACTGGTACCAACC |
| 3226 | KRT19 | 3757122 | GGGGCAAAATATGCTTCGCATAGTGGGGGGGCAGGTATAGACAAAATCTACCCCCCATCTGGTTTATAGACCCCCTTCAGGCCATTTAGAGTTTCATTGCACACAGGTCTCAGAGATTTCCTCCCCAGGCTTGCCTTCCTGCCCTCCCCCACCCAAGTCCCCCTGGCTCCAGTTTTCTTCCTGCCCCAGCTTCTGGGCATGGACTGTTTGCAAGGCCTCCCAGAGAGCGGGCCAATGGGC |

TABLE 13-continued

Subtyping Target Sequences

| SEQ ID NO. | Gene | Affy Probeset ID | Sequence |
|---|---|---|---|
| 3227 | KRT19 | 3757124 | TATCGCCAGTCGTCGGCCACGTCGTCCTTCGGAGGCCTGGGCGGCGGCTCCGTGCGTTTTGG<br>GCCGGGGGTCGCCTTTCGCGCGCCCAGCATTCACGGGGGCTCCGGCGGCCGCGGCGTATCCG<br>TGTCCTCCGCCCGCTTTGTGTCCTCGTCCTCCTCGGGGGCCTACGGCGGCGGCTACGGCGGCG<br>TCCTGACCGCGTCCGACGGGCTGCTGGCGGGCAACGAGAAGCTAACCATGCAGAACCTCAAC<br>GACCGCCTGGCCTCCTACCTGGACAAGGTGCGCGCCCTGGAGGCGGCCAACGGCGAGCTAG<br>AGGTGAAGAT |
| 3228 | COL1A1 | 3762199 | TCCGCAGTGGCCTCCTAATTTCCTTCTTTGGAGTTGGGGGAGGGGTAGACATGGGGAAGGGG<br>CTTTGGGGTGATGGGCTTGCCTTCCATTCCTGCCCTTTCCCTCCCCACTATTCTCTTCTAGATCC<br>CTCCATAACCCCACTCCCCTTTCTCTCACCCTTCTTATACCGCAAACCTTTCTACTTCCTCTTTCAT<br>TTTCTATTCTTGCAATTTCCTTGCACCTTTTCCAAATCCTCTTCTCCCCTGCAATACCATACAGGC<br>AATCCACGTGCACAACACACACACACACTCTTCACATCTGGGGTTGTCCAAACCTCATACCCAC<br>TCCCCTTCAAGCCCATCCACTCTCCACCCCCTGGATGCCCTGCACTTGGTGGCGGTGGGATGCT<br>CATGGATACTGGGAGGGTGAGGGGAGTGGAACCCGTGAGGAGGACCTGGGGGCCTCTCCTT<br>GAACTGACATGAAGGGTCATCTGGCCTCTGCTCCCTTCTCACCCACGCTGACCTCCTGCCGAA<br>GGAGCAACGCAACAGGAGAGGGGTCTGCTGAGCCTGGCGAGGGTCTGGGAGGGACCAGGA<br>GGAAGGCGTGCTCCCTGCTCGCGTGTCCTGGCCCTGGGGGAGTGAGGGAGACAGACACCTGG<br>GAGAGCTGTGGGGAAGGCACTCGCACCGTGCTCTTGGGAAGGA |
| 3229 | COL1A1 | 3762200 | ATTATTTTGATTGCTGGAATAAAGCATGTGG |
| 3230 | COL1A1 | 3762201 | TTCTAAAGGTGCTATTTAACATGGGAGGAGAGCGTGTGCGGCTCCAGCCCAGCCCGCTGCTC<br>ACTTTCCACCCTCTCTCCACCTGCCTCTGGCTTCTCAGGCCTCTGCTCTCCGACCTCTCTCCTCTG<br>AAACCCTCCTCCACAGCTGCAGCCCATCCTCCCGGCTCCCTCCTAGTCTGTCCTGCGTCCTCTGT |
| 3231 | COL1A1 | 3762202 | TCCACTTGCTTGAAGACCCATGCGGGGGTAAGTCCCTTTCTGCCCGTTGGGCTTATGAAACCC<br>CAATGCTGCCCTTTCTGCTCCTTTCTCCACACCCCCCTTGGGGCCTCCCCTCCACTCCTTCCCAA<br>ATCTGTCTCCCCAGAAGACACAGGAAACAATGTATTGTCTGCCCAGCAATCAAAGGCAATGCT<br>CAAACACCCAAGTGGCCCCCACCCTCAGCCCGCTCCTGCCCGCCCAGCACCCCCAGGCCCTGG<br>GGGACCTGGGGTTCTCAGACTGCCAAAGAAGCCTTGCCATCTGGCGCTCCCATGGCTCTTGCA<br>ACATCTCCCCTTCGTTTTTGAGGGGGTCATGCCGGGGGAGCCACCAGCCCCTCACTGGGTTCG<br>GAGGAGAGTCAGGAAGGGCCACGACAAAGCAGAAACATCGGATTTGGGGAACGCGTGTCA<br>ATCCCTTGTGCCGCAGGGCTGGGCGGGAGAGACTGTTCTGTTCCTTGTGTAACTGTGTTGCTG<br>AAAGACTACCTCGTTCTTGTCTTGATGTGTCACCGGGGCAAC |
| 3232 | COL1A1 | 3762203 | GACAATTTCACATGGACTTTGGAAAATATTTTTTTCCTTTGCATTCATCTCTCAAACTTAGTTTTT<br>ATCTTTGACCAACCGAACATGACCAAAAACCAAAAGTGCATTCAACCT |
| 3233 | COL1A1 | 3762206 | AGCTGACCTTCCTGCGCCTGATGTCCACCGAGGCCTCCCAGAACATCACCTACCACTGCAAGA<br>ACAGCGTGGCCTACATGGACCAGCAGACTGGCAACCTCAAGAAGGCCCTGCTCCTCCAGGGC<br>TCCAACGAGATCGAGATCCGCGCCGAGGGCAACAGCCGCTTCACCTACAGCGTCACTGTCGA |
| 3234 | COL1A1 | 3762207 | AGACTGGTGAGACCTGCGTGTACCCCACTCAGCCCAGTGTGGCCCAGAAGAACTGGTACATC<br>AGCAAGAACCCCAAGGACAAGAGGCATGTCTGGTTCGGCGAGAGCATGACCGATGGATTCCA |
| 3235 | COL1A1 | 3762208 | AGCGCTGGTTTCGACTTCAGCTTCCTGCCCCAGCCACCTCAAGAGAAGGCTCACGATGGTGGC<br>CGCTACTACCGGGCTGATGATGCCAATGTGGTTCGTGACCGTGACCTCGAGGTGGACACCAC<br>CCTCAAGAGCCTGAGCCAGCAGATCGAGAACATCCGGAGCCCA |
| 3236 | COL1A1 | 3762209 | CCAAAGCACTTGGATGCCGGTAATCCCCACTCTCTT |
| 3237 | COL1A1 | 3762210 | CCTGGCAAAGATGGACTCAACGGTCTCCCTGGCCCCATTGGGCCCCCTGGTCCTCGCGGTCGC<br>ACTGGTGATGCTG |
| 3238 | COL1A1 | 3762211 | TGGTGAACAAGGTCCCTCTGGAGCCTC |
| 3239 | COL1A1 | 3762212 | TGAGACAGGCGAACAGGGCGACAGAGGCATAAAGGGTCACCGTGGCTTCTCTGG |
| 3240 | COL1A1 | 3762213 | TGCTGGTCCCACCGGTCCTGTCGGCCCTGTTGGCGCCCGTGG |
| 3241 | COL1A1 | 3762214 | TGACCGTGGTGAGACCGGCCCCGCTGGACCCCCTGGTGCTCCTGGTGCTCCTGGTGCCCCTG<br>GCCCCGTTGGCCCTGCTGGCAAGAGTGGTGATCGTGGTGAGACT |
| 3242 | COL1A1 | 3762215 | GCTCCTGGTGCCGAAGGTTCCCCTGGACGAGACGGTTCTCCTGGCGCCAAG |
| 3243 | COL1A1 | 3762216 | GGCAAACAAGGTCCCTCTGGAGCAAGTGGTGAACGTGGTCCCCCTGGTCCCATGGGCCCCCC<br>TGGATTGGCTGGACCCCCTGGTGAATCTGGA |
| 3244 | COL1A1 | 3762217 | GTACTCCCGGGCCTCAAGGTATTGCTGGACAGCGTGGTGTGGTCGGCCTGCCTGGTCAGAGA |
| 3245 | COL1A1 | 3762218 | GCTGGCAAAGAAGGCGGCAAAGGTCCCCGTGGTGAGACTGGC |
| 3246 | COL1A1 | 3762220 | GTGCTACTGGTTTCCCTGGTGCTGCTGGCCGAGTCGGTCCTCCTGGCCCCTCT |

TABLE 13-continued

Subtyping Target Sequences

| SEQ ID NO. | Gene | Affy Probeset ID | Sequence |
|---|---|---|---|
| 3247 | COL1A1 | 3762221 | CTGGAGCCAAAGGTGCTCGCGGCAGCGCT |
| 3248 | COL1A1 | 3762222 | TGCTGACGGCCAACCTGGTGCTAAAGGCGAACCTGGTGATGCTGGTGCTAAAGGCGATGCTGGTCCCCCTGG |
| 3249 | COL1A1 | 3762223 | GAGACCGTGGTGAGCCTGGTCCCCCCGGCCCTGCTGGCTTTGCTGGCCCCCCT |
| 3250 | COL1A1 | 3762224 | GTAAGTACAGAAGACCTGTTAAGACCCCATACTTGGCCCTTCCCTCCCTTCACACAGCACCCCTGGCCCTGTCTGTGCCTTCACCCCTTGCCTCTCCCCTCACCGCATCCCCGCCTTCCCTCCTGTCAGCGCATCTCTCCAATCTGACTCCTTTTCT |
| 3251 | COL1A1 | 3762226 | TGCTGGTCCCAAAGGTGCTGATGGCTCTCCTGGCAAAGATGGCGTCCGTGGTCTGACTGGCCCCATT |
| 3252 | COL1A1 | 3762227 | AGCTCCCGGTAGCCAGGGCGCCCCTGGCCTTCAGGGAATGCCTGGTGAACGTGGTGCAGCTGGTCTTCCAGGGCCTAAGGGTGACAG |
| 3253 | COL1A1 | 3762228 | CGAGCGTGGTGTGCAAGGTCCCCCTGGTCCTGCTGGTCCCCGAGGGGCCAACGGTGCTCCCGGCAACGATGGTGCTAAG |
| 3254 | COL1A1 | 3762229 | GGTGTTCCTGGAGACCTTGGCGCCCCTGGCC |
| 3255 | COL1A1 | 3762230 | CTGCTGGAATATGCTGTGACTTTCCCTCAACCCTTCTATTGATAAATCTTGGTCCATAGTTTGGGGAGGGGGGAAGCCTTTGACACATCCCTAGGAGGAAGAGAGGGGCTGTTTGGGATAATCTCAATTCAGTGCTGAGAAGGGGTTCCTCTCTAATCACGGCCAGACCCCAGGAGGAAGGACCGTGCTTTCCAGCAGAGTGGCCCCAGGTGGGTTTTGCTCACTGTCT |
| 3256 | COL1A1 | 3762231 | GTGAAGCAGGCAAACCTGGTGAACAG |
| 3257 | COL1A1 | 3762236 | CTGGAGAGCGAGGTGTTCCCGGACCC |
| 3258 | COL1A1 | 3762237 | AGAGCCAGGGACAAACACACCTGAGACTTGAAGGAGTCCTGGGCTCTGGGCTCAGCTGTGCCGCTGACCTGCCGTGTG |
| 3259 | COL1A1 | 3762238 | TGGGATTCCCTGGACCTAAAGGTGCTGCT |
| 3260 | COL1A1 | 3762239 | TCAAGATGGTCGCCCCGGACCCCCA |
| 3261 | COL1A1 | 3762240 | GTCCTCACTGCTGCTTTCGTGCCTCCCAT |
| 3262 | COL1A1 | 3762241 | CTGGTCCTGATGGCAAAACTGGCCC |
| 3263 | COL1A1 | 3762242 | TGAAGCTGGTCGTCCCGGTGAAGCTGGTCTGCCTGGT |
| 3264 | COL1A1 | 3762243 | GTCCCGCTGGTGAACGTGGTTCTCCTGGCCCTG |
| 3265 | COL1A1 | 3762244 | GTTTCCCTGGCGCAGATGGTGTTGCT |
| 3266 | COL1A1 | 3762245 | GGAGCTCGAGGTGAACCCGGACCCACTGGCCTGCCCGGACCCCCTG |
| 3267 | COL1A1 | 3762246 | GGCAGCAAAGGAGACACTGGTGCTAAGGGAGAGCCT |
| 3268 | COL1A1 | 3762247 | TGCTCCTGGTATTGCTGGTGCTCCTGGCTTCCCTGGTGCCCGAGGCCCCTCTGGACCCCAG |
| 3269 | COL1A1 | 3762250 | GGCCCCGAGGCTCTGAAGGTCCCCAGGGTGTGCGTGGTGAGCCTGGCCC |
| 3270 | COL1A1 | 3762251 | CCCACCGGCCCCGCTGGTCCTCCTGGCTTCCCTGGTGCTGTTGGTGCTAAG |
| 3271 | COL1A1 | 3762252 | GTGCTCGTGGAAATGATGGTGCTACTGGTGCTGCCGGGCCCCCT |
| 3272 | COL1A1 | 3762253 | GGCCCCGTGGCCTGCCTGGTGAGAGAGGTCGCCCTGGAGCCC |
| 3273 | COL1A1 | 3762254 | GCAGCCCTGGTGAAAATGGAGCTCCTGGTCAGATG |
| 3274 | COL1A1 | 3762255 | TCACTCATTATTCTCTGATCTACAG |
| 3275 | COL1A1 | 3762256 | TGGTTTGGATGGTGCCAAGGGAGATGCTGGTCCT |
| 3276 | COL1A1 | 3762258 | AGCTGGAAAACCTGGTCGTCCTGGTGAGCGTGGGCCTCCT |
| 3277 | COL1A1 | 3762259 | CCAGGTCCCCCTGGAAAGAATGGAGATGAT |
| 3278 | COL1A1 | 3762260 | CAAGGCTTCCAAGGTCCCCCTGGTGAG |

TABLE 13-continued

Subtyping Target Sequences

| SEQ ID NO. | Gene | Affy Probeset ID | Sequence |
|---|---|---|---|
| 3279 | COL1A1 | 3762263 | CCCAGCTGTCTTATGGCTATGATGAGAAATCAACCGGAGGAATTTCCGTGCCTGG |
| 3280 | COL1A1 | 3762264 | TGGACAGCCTGGACTTCCCGGACCC |
| 3281 | COL1A1 | 3762265 | AGGCCCCCCTGGCCGAGATGGCATCCC |
| 3282 | COL1A1 | 3762266 | CCAAGGGAGACACTGGCCCCCGAGGCCCAAGG |
| 3283 | COL1A1 | 3762267 | CGACCAAGAAACCACCGGCGTCGAG |
| 3284 | COL1A1 | 3762268 | CCTGCGTACAGAACGGCCTCAGGTACCATGACCGAGACGTGTGGAAACCCGAGCCCTGCCGGATCTGCGTCTGCGACAACGGCAAGGTGTTGTGCGATGACGTGATCTGTGACGAGACC |
| 3285 | COL1A1 | 3762269 | TCAGCTTTGTGGACCTCCGGCTCCTGCTCCTCTTAGCGGCCACCGCCCTCCTGACGCACGGCCAAGAGGAAGGCCAAGTCGAGGGCCAAGACGAAGACA |
| 3286 | ACOX1 | 3771216 | TGGTCTGTAACACCTGCACATCTTTTTATACGTGTAGAGGGTATGCCTGGGATATATAGGTTGTCTTCAAGCAGTAGCTGCTACTACAGCTAGAGAGAGGAGGAGTGCCAGGAAACTGATGACCTGAGACCAAGAGTCTTGTTGATGTTCTGACTTAGATAAAGGTTTTGATCATTTTCATGAAATAATGCAGGGAAGTCATTTCTGCTGTTTCTTTACTACTCCATTCTTGGAGGATTAGAACAAGTCACACTGTAATTGACTAAAACGACTTTTTATTTTAAAATATTGATGGTGGGGTTTTGCTTTTTTTTTTTTTTTTTTTGAGACGTTGTCTTGCTCTTTCACCCAGGGTAGAGTGCAGTGGCGAAATCTTGGCTCACTGCAACCTCTGCCTCCCGGGTTCAAGCAATTCTCTGCCTCAGCCTCCTGAGAAGCTGGGATTACAGCGCCTGCCACCATGCCTGTCTAGTTTTTTTGTATTTTTAGTAGAGACAGGGGTTTCACCAAGTTGGCCAGGCTGGTCTTGAACTCCTGACCTCGTGATCCACCCACCTCGGCCTCCCAAAGTGCTGGGATTACAGGCGTGAGCCACCGTGCCGGGCCAGTGTTTTTAACTGTCCACACTTACTAAATTTTCCAGTACTTCTTCCTATGGTTCATGATAGTAAACACAGAAACATATAAGGAACATTATTAGAGTTACCAGATGTTAGCTGTTGCATATGTGCACATTCCTAGATTCAAGGGTGTTTTTGCCTTAAATTTAAGTGGGTCATTGGTTGTCTTGGGAAGATCATGGAAAATTCGGGATTTTTTAGAATTCTGAACCAAAATATGTTTTGAGTGTTTCTTAGTAAATGTGTGATCTTCCACCTTCCACATTCAGACTGCGGACTACACTTCATAAATGCCTTTTATTTCCAGTTATGGATTCAACTAAATGACTGCCTTGGGAGCACATAATTACTTTGCTACCTTTTTCCCCCTTTGCTGTTGTGGCTCGAGTTTGGTTCTCACCTGAGAAGATGCATTGAGCATATGTTGTTACCCAGCCCTG |
| 3287 | ACOX1 | 3771217 | GCTCCAGTCACTTTAGGAGTCCTTGGAAGTACTTGGTACACATTGTTGGCTGTACCTTAAAGGAAGTGGCAAGTCCAGTTTGTTCTCTCTACCACACTAGACTGCCACTGACAAGTTTGGGTCTGTTGGATTCAAAATTTTGTAAGCCATTTTCACAAGTACAAAGATACATTTTAACCTTGTCTTCTCCAAAATTACTGAGTAGGAATTTTATTTTTATCTTTTTGAGACAGGGTATCACTGTCACCCAGACTGGAGTGCAGTGGTGGGATCTTGGCTTACTGTGACCTCTGCCTCCCGGGTTCAAATGGTCCTCCCTCCTCAGTCTCCTGAGTAGCTGGGACGACAGGCACGTGCCACCATGCCCAGCTAATTTGTTCTATTTTTTCTGTAGAGACGGGGTTTTGCCATGTTGCCCAGGCTGGTCTCAGACTCCTGGGCTCAAGCGATCATTTCGCCTCAGCCTCCCAAAGTGCTGAGATTATAGGTGTGAGCCACAGCATCTGGCCCAGAGTGAGGAGAATTAATGAGATTTTTGTGTGTGTTAGATAATATTGATTTAAGCCTTTTTTAAAAAGTACTCTCAACCAAATACAAAATTGAAAATGTGAGGTTTAATAGAAATGTGTTGGCTATTTGCAATGGATTTTCTTCTTGCCCAAGTGTTTGGAGTTCTACTTTATGCTCTGTATTTAAAAATTAGTGACCTCAAAGCAGAGTTGATGACACAGGCTTTGGGGCCCTCATGTTCTTGTCTTTAGAACATATCACTACTAAGTATCAGCTTATCTTCAGAACATTACAACATTCACCGTGTTCATATGCTTTCTGAGAAGTCACCACTTGTAATTTCAGATCACATACACCTGAAGGCATTTTATAGTTCCTAAAGTTAACATGTTAGATCTTTTTTTTCCACCCCATGAGGGTCTCACTCTCACCCAGGCTGGAATGCAGTGGTGTGATTGTAGCACACTTTGGCCACCAACTCCTGGGCTCAAGTGATCCTCCTGCTTTGGCCTCCTCTGAGAAGCTGGGATTACTGGTGCACACCACCACACCTGGCTAATTTTTATTCTTTTTATTTTTGGAAATAGGGTATGGCTATGTTGCCTTGGGCCCGTCATGAACTCCTAGCCTCAGGTGACCCTCCCACCTCAGGCCTCCCAAAGGGTTGGGATTACAGGAGTGAGCTACTGCACTGGGCCAACATG |
| 3288 | ACOX1 | 3771218 | AACTCCTATCTTGGGACCTGACATAATATCTATCTATCCTGGGGAACTGGTAATATGAGACTTATAGGTTACAGCAGAAATGCTACATGTTGACAAAAGCCTTAATCGTTCCACTGGGAGAACTAATTGATAATTGTGTTAAGATTGAAGATTAACCCTGTGTTAATCTCACTTGAGTCTATCCTGACAGTAGTTCAGATTCTGGAAAATGATAAACTGACCTGCTAGATGTAGAATTGTTTCAAAATTAGTGTTGAAATACCTTGTTCACAGATGAATATCTGGGCAGGATCTGAGGGTGTTTGGAATGACACCCCCCAATCCAGTTGCATAGATGGGATGTCTTTGCAGGTTTGAGGAGATCATCGACC |
| 3289 | ACOX1 | 3771219 | TGTCACTTAGGTCAGCACTCCCAGACGTAGCACAGAAAAACCCTTTGACACAAACCATGTGTTCTGATTTTTGGTTCAGAAAATATTGAAACTGTGAGTTGTTTTTTTTTTAACAACTGGGAAAAAACAAAAACAAAAACTATAGTTAGAAAATGGAAGTTCCATAGGTTCTATTTCTTACTCTATGTATGGCTTTGTTTTCAGTCTATTTCTAGGAGCTTTCTCTGAATCGCTAATTGTCC |
| 3290 | ACOX1 | 3771220 | GCTAGCATTTTTCCAACGAGGGAACTTATTCCGCACGGGCCTACTGTAGGACCATTGTCTCGTGTAATTAGGAATTTTCCATTTGAAGGATTGCTAAATTGTCACAGTAGTAGGAAGTATAGGGAAACCTCTCAGCTGTGGCACTG |
| 3291 | ACOX1 | 3771221 | TGGGGCCTGGCTTAAAAGCAGGATTG |

TABLE 13-continued

Subtyping Target Sequences

| SEQ ID NO. | Gene | Affy Probeset ID | Sequence |
|---|---|---|---|
| 3292 | ACOX1 | 3771222 | GCGCCTGTGTGCAACTCAAATTTTGTGGAATCTTTTTCGAATTCAAATAGCTATAGAGCAAAT GATAAATTGACCCCTTTTTATAAATGGAGGGAAAAAATGAACAGATTTCAGAGATTAAATGAA AAAAAGCAGATGTTTTAAGTGCAATTAACACTGAAAGAGACCTGTTAAACCATTCAGAAAAA GCTTAAGAAATGCGATATGACTTCCTTTTGTAATGCTGCTGATCCCAGTAGACTATGACTTTTG ATAATTAGCAGAATTTAACTACTGAGTAGTTGATTATTTTCACATTTTAATTGCTAATCACTGG CTATATAAGTGTTTTTAAGCAAAGGTATTTTTGAAGTGGTGTAGAACCCTTCCA |
| 3293 | ACOX1 | 3771224 | CAGCGTGTAAAGGAGTTACTCACTCTGATTCGCTCAGATGCTGTTGCTTTGGTTGATGCATTT GATTTTCAGGATGTGACACTTGGCTCTGTGCTTGGCCGCTATGATGGGAATGTGTAT |
| 3294 | ACOX1 | 3771226 | AAAGCAAGGAGGTAGCTTGGAACCTAACT |
| 3295 | ACOX1 | 3771227 | TTAGTAGAAATTGCTGCAAAAAACCTTCAAAAAGAAGTGATTCACAG |
| 3296 | ACOX1 | 3771228 | ATTTGAACGACCTGCCCAGTCAGCGCATCCAGCCACAGCAGGTAGCAGTCTGGCCAACCATG GTGGATATCAACAGCCCCGAAAGCCTAACCGAAGCATATA |
| 3297 | ACOX1 | 3771230 | GCCCTCACCGCTGGACTGAAGGCTTTCACCTCCTGGACTGCAAACACTGGCATTGAAGCATGT CGGATGGCTTGTGGTGGGCATGGCTATTCTCATTGCAGTGGTCTTCCAAATATTTATGTCAATT TCACCCCAAGCTGTACCTTTGAGGGAGAAAACACTGTCATGATGCTCCAGACGGCTA |
| 3298 | ACOX1 | 3771232 | GCAGTATAAACTCTTTCCACTCCTGGCCACTGCCTATGCCTTCCAGTTTGTGGGCGCATACATG AAGGAGACCTATCACCGGATTAACGA |
| 3299 | ACOX1 | 3771234 | TTCAGATCCCAGAATTCCCAAATGTCAATACAGAAGATGCATTAGCACTGCAAAATTGGCTAG GGTGATAACTGGGCCTGTAATTTCATATCTAGGCTTCCTTTTCTTAAGAGGAAAGACAGAAAT AACCACCCTTGCTATA |
| 3300 | ACOX1 | 3771235 | TGATGGCACATACGTGAAACCGCTGAGTAACAAGCTGACTTACGGGACCATGGTGTTTGTCA GGTCCTTCCTTGTGGGAGAAGCTGCTCGGGCTCTGTCTAAGGCGTGCACCATTGCCATCCGAT ACAGCGCTGTGAGGCACCAGTCTGAAATCAAGC |
| 3301 | ACOX1 | 3771238 | CATGCAATAGTTCTTGCCCAGCTCATCACTAAGGGGAAATGCTATGGATTACATGCCTTTATC GTACCTATTCGTGAAATCGGGACCCATA |
| 3302 | ACOX1 | 3771239 | GTAAGTGAATTTTTCAGCATTTATTGGATGTTTTGAAG |
| 3303 | ACOX1 | 3771241 | CCTCTGGATCTTCACTTGGGCATGTTCCTGCCCACCTTGCTTCACCAGGCAACTGCGGAGCAG CAGGAGCGCTTCTTCATGCCCGCCTGGAACTTGGAGATCATTGGCACTTATGCCCAGACAGAG ATGG |
| 3304 | ACOX1 | 3771244 | CCACCTCAGGACATCAGTTAACAGTGATTGCTGGCATTTGACTTTTTTCTGCTGCTACCTGTTT GGGATTCTATTTTTAAGTTGTTAAGTCAAAATTCAACTTCTTGTTTTCTCCTAGACATTTTCCCT GGAAACTGGTCCAGGGCTCTGGCCTATAAACGTCATTCACTG |
| 3305 | ACOX1 | 3771245 | ACCTGTGGGCCTCAATTACTCCATGTTATTCCTACCTTGCTGAATCAGGGCACCACTGCTCAG AAAGAGAAATGGCTGCTTTCATCCAAAGGACTCCAGATAATTGGCACCTACGCCCAGACGGA AATGGGCCACG |
| 3306 | ACOX1 | 3771252 | AGAGCAAGTGTTGTTAAGCCTAAACT |
| 3307 | ACOX1 | 3771253 | ATGAGGGAGTTTGGCATCGCTGACCCTG |
| 3308 | ACOX1 | 3771254 | GAACATGATCCTGAACGACCCAGACTTCCAGCATGAGGACTTGAACTTCCTCACTCGCAGCCA GCGTTATGAGGTGGC |
| 3309 | ACOX1 | 3771255 | ATGAACCCGGACCTGCGCAGGGAGCGGGATTCCGCCAGCTTCAACCCGGAGCTGCTTACACA CATCCTGGACGGCAG |
| 3310 | ACOX1 | 3771256 | GCCGCTGTCACTCACGCGCCAAAGGGCCACGGAGAAAGAAGGGGCGGGCCGGGGCGGGCC GGGCGAGCGGAGGCGGGACTTGCGCCGTCCTGAGGCTGCCTCCTAGGGTCCGGCCGGCGC TGGAGCTGCGGATTTAGATTGTCACTGCCACCTCGGTCGGTGCTTACTTCGCTGCCAGCTGGT CGTCG |
| 3311 | TIMP2 | 3772662 | TCGGTCCGTGGACAATAAACAGTATT |
| 3312 | TIMP2 | 3772663 | CTTGCTGCCGTAATTTAAAGCTCTGTTGATTTTGTTTCCGTTTGGATTTTTGGGGGAGGGGAG CACTGTGTTTATGCTGGAATATGAAGTCTGAGACCTTCCGGTGCTGGGAACACACAAGAGTT GTTGAAAGTTGACAAGCAGACTGCGCATGTCTCTGATGC |
| 3313 | TIMP2 | 3772664 | ACGGGGCTTTCTGCATGTGACGCCAGCTAAGCATAGTAAGAAGTCCAGCCTAGGAAGGGAA GGATTTTGGAGGTAGGTGGCTTTGGTGACACACTCACTTCTTTCTCAGCCTCCAGGACACTAT GGCCTGTTTTAAGAGACATCTTATTTTTCTAAAGGTGAATTCTCAGATGATAGGTGAACCTGA GTTGCAGATATACCAACTTCTGCTTGTATTTCTTAAATGACAAAGATTACCTAGCTAAGAAACT |

TABLE 13-continued

Subtyping Target Sequences

| SEQ ID NO. | Gene | Affy Probeset ID | Sequence |
|---|---|---|---|
| | | | TCCTAGGGAACTAGGGAACCTATGTGTTCCCTCAGTGTGGTTTCCTGAAGCCAGTGATATGGG GGTTAGGATAGGAAGAACTTTCTCGGTAATGATAAGGAGAATCTCTTGTTTCCTCACCTGT GTTGTAAAGATAAACTGACGATATACAGGCACATTATGTAAACATACACACGCAATGAAACC GAAGCTTGGCGGCCTGGGCGTGGTCTTGCAAAATGCTTCCAAAGCCACCTTAGCCTGTTCTAT TCAGCGGCAACCCCAAAGCACCTGTTAAGACTCCTGACCCCCAAGTGGCATGCAGCCCCCATG CCCACCGGGACCTGGTCAGCACAGATCTTGATGACTTCCCTTTCTAGGGCAGACTGGGAGGG TATCCAGGAATCGGCCCCTGCCCCACGGGCGTTTTCATGCTGTACAGTGACCTAAAGTTGGTA AGATGTCATAATGGACCAGTCCATGTGATTTCAGTATATACAACTCCACCAGACCCCTCCAACC CATATAACACCCCACCCCTGTTCGCTTCCTGTATGGTGATA |
| 3314 | TIMP2 | 3772665 | GCCTCCAAGGGTTTCGACTGGTCCAGCTCTGACATCCCTTCCTGGAAACAGC |
| 3315 | TIMP2 | 3772666 | TGCCTCTGGATGGACTGGGTCACAGAGAAGAACATCAACGGGCACCAGGCCAAGTTCTTCGC CTGCATCAAGAGAAGTGACGGCTCCTGTGCGTGGTACCGCGGCGCGGCGCCCCCCAAGCAG GAGTTTCTCGACATCG |
| 3316 | TIMP2 | 3772667 | GGCACTGCAGGCCTTACGCTGTTTCCAACATTCCCGACATTTTCACACCTGGGTTGGTGTCTAT GTGGGGTCTGTGTGTTGAGAATACCTGAACACCTGCTCCTCTTAAAATGAGCCCGGAGGTTGT GCCAGGCACAGCTGGAGCAGTGCAGCGCCTAGATGTGGCTGTGGAAGGTGAGATTACCGCC TCCAGGGCTCCCAGGCTGGCTCCTACCCTGTGGGCTCCTAGCACCCTATCCCCACCCTCCCTGC AGGAAGCATGGCTGAGTGCTGGGCACCTCCCACCCTGGGTCACTCCCAGTGAGTCTGGGACC AGGAGACTCTGGTGAGGCTGTGGGGATTGGCCTTCCCTGGGGAGCTGCCTGGGGCTGCCCTC CCTCCTGACGGCCCCCAGCCCCTTCTCCGCATGTTCAAAACAGGAATTCTGAACTCATAGTCTC CAGCCACACGTATGTTAAGCGAAACTCCTCTGTGCCCAGCATGAAATCAAAAGCAAGTTTTTC CTTTTTCTTTCCACGGTGGTGAAGGCGGTCATCCTCTTGTAGCCTAGGGTTCCTTGGCCAAATT GCTAGTTGCCGATGACCTCG |
| 3317 | TIMP2 | 3772668 | GTACCAGATGGGCTGCGAGTGCAAG |
| 3318 | TIMP2 | 3772669 | GCAAGATGCACATCACCCTCTGTGACTTCATCGTGCCCTGGGACAC |
| 3319 | TIMP2 | 3772672 | GGATATAGAGTTTATCTACACGGCCCCCTCCTCGGCAGTGTGTGGGGTCTCGCTGGACGTTGG AGGA |
| 3320 | TIMP2 | 3772675 | TGATCAGGGCCAAAGCGGTCAGTGAGAAGGAAGTGGACTCTGGAAACGACATTTATGGCAA CCCTATCAAGAGGATCCAGTATGAGATCAAGCAGATA |
| 3321 | TIMP2 | 3772676 | GCAGGCCTGGACGTCTTATCCCTCTCCTTAGCCCCAGGAGCGTGTTTCAGGAACTCTCCTCACC TCTGT |
| 3322 | TIMP2 | 3772677 | GAGGAGACGCCATGCCGGGGGCTGGGATCACCATGCCCCTTGCCCGTCTCGCACCTTGCTGCT |
| 3323 | TIMP2 | 3772695 | CCCACCCGGGGTAAATACATCACTGAT |
| 3324 | TIMP2 | 3772696 | GTTTCTTGAAGAAGCCCGGAAATGCTTGCGGGAGTTTCAGAACATATGCTAA |
| 3325 | TIMP2 | 3772697 | GGCTGAGCCTCTGTCCTGATAACGAAGACCTGCTTTGGAGGAAAAAGCACAAATTGCTACAA GCCCGGGGCAAAGGCGATCTCGCTCTGCAGAGAAGAGCGGATGCCAAGCTGTGGAAAAACT ACCAGCTCCAGCGCTTGGCTGAGGAGTTGAGGAGAGGGTATCAGGAGGCACAGCACCTGCA CGTCGGTGGCCTGGACAGGCTGCAGTCAGCACGTCGTTGGGCTGGGGAGGAGGACGGGCC AGGGAAAATGAGCCTGACTCGCAGGGGCCCATCCAGCGAAGATCAGCCAGGCCCCCGAGGG CCAAGGAGAAGCATAGAGCAGCCCTTAGTGAAGAGAGGAGTTGCAGGGAAGAGTTGGAGCC AGCAACACCCCAGGCACTCCAGGCCCCGGAAGACAGCAGCGAGTCCAGAGAAACCACAGAC TACAAAAGCCACGGGTCGGATGAATTCTCACCTGGCCCCGCCTGAGAAGAGAAAGGGAAGG CCAGAACCTTCGACCAAGTCTGGGGGTGGCCGCTGTGCCATCCATCCTCGGAGGAGCAAAGG GGCGGACCTAGAAAGGTCAAACCCACTCGTGGCTGCTGTGGGAGAAATCGGGCTTGTGGAG GAAAAAGAGAAAGGAACAGCTCGGGCGGGGAGGAGGCAACTGGGAAAGGGGGCAGTTTG CTTTGTTCCAGCCCTGACCAGTCGCTCTCAGGGACAGAGTCTGGAGGGGAAGCTGAGAGACC TCGGGCAGCTGTGGCCAGCTGATTCCAGCTGCAGAAGGGAAGCCGTGTCCCAGCATCTCAG TGCACGCTCCGGAGAAGAACAAGTGGCAGAAAGAGCTGGAGTTGGCCTTTGAAGAGTTGT TTAATATAAACAGAAAGCTGAAAAAACACCTGCTTGTACCTGGCACTGAAGCCCAGGATG GACCAGAGACCTGGGGAAGGGCATGCCTTCTCAGAGATGCAAGAGTGTGGCGCTGGGACCC CAAGAGGGAAGAAAATGGCAGACCCAGAGATGCTGCCTGCCGGGGAACCCAGGAGCCCAGC AGAGGAGGAGGCGCAGCAGGCAGCGTCCAAGACCGACTTGAAAACGTTCATGGGCAAGGCC CAGAACCAAAAATATCAGGGCACGGTCAAGCCCACGTTTAGAAATGGAAGTCAAACATTGTC TCCCGAGGCAGGTATATTTATCA |
| 3326 | TIMP2 | 3772698 | TTTGCTGTGGAACGTTGTGGCTTCGTGTGGCTCCTCAGGCCCGGGGCGCCCCTTGAACCCTCC ACTCTTGGCTCCAAGCACCTTCCCTGGGAAGCTGTATCTGCTGGGTTCGCAGACAGGAACAGA |
| 3327 | TIMP2 | 3772702 | AGGCACTTCGTAGCTGTTGACCATCATTTAGCTCCACGTCTGCCCGTCGGTTCCTCGTGCGTG GAATCCAGCACCACGTGGGTGTCTCTGCCGAGCTCTCGGCATTTCCTGAGCCCTCCCGGAAGC CAGACTCTGTTCTCGGCGCTTCACACGGGCCGTCTCGTCTGATG |

TABLE 13-continued

Subtyping Target Sequences

| SEQ ID NO. | Gene | Affy Probeset ID | Sequence |
|---|---|---|---|
| 3328 | TIMP2 | 3772703 | CCAGTGATTTCAAGACAGCCCTGGAGACAGTGCTTCCTGCCCTCCTGTCAGCTTCTGCCTCCCT<br>GTAATGTGTTCTGGGTGGTCTAGCTCAGTCATCTGG |
| 3329 | TIMP2 | 3772706 | CAGGTGGAGGCGGGGAAGCGATTCCGGCCA |
| 3330 | PTPRM | 3777471 | CGGCGAGCTCAGCAACCGGAACCGAGGGAAGATTTTGGCTCCGCGGGCTCGCCCTCCGCTCC<br>CTCTGCCAGCGGCGCCCAGACGCCGAGTGGGGCCAGGGACAGGGGAGGAGGACCCAGGACC<br>CTGTGCCCGCGCCCCTGGAGCCGCTGGAGTTCGGACTTCTGCAACTGTTGGCACTTTGGGGG<br>CTTGGCTTAGCGCTCTGCTGTTTAC |
| 3331 | PTPRM | 3777472 | GACTTGGGACTTGCCTGGCGACTTTGGCCGGACTTTTGCTAACTGCGGCGGGCGAG |
| 3332 | PTPRM | 3777522 | GCCGGAGCATGCTTCTCTAATCTTACCATTTATCACTGACCCTTCGGTGAAACTCTCTTCTGTTT<br>AAATTTACCAGGGTACACTTTGTAATACTTGGGACCAAGAATTTGAAGATAGTAATCAGACAA<br>ATCAAACAACTAGTAGTAGTGGAGAGACACGTAGCCCTACA |
| 3333 | PTPRM | 3777525 | GGCTGCCTCTTTGATGAGCCGTATAGCACATGTGGATATAGTCAATCTGAAGGTGATGACTTC<br>AATTGGGAGCAAGTGAACACCTTGACTAAACCGACTTCTGA |
| 3334 | PTPRM | 3777535 | CCTGCAACAAACTTGCTGGGGCCTGCTGTGTGTACACACTGTATCAGGCTGGGTGTACCTCGT<br>TAAGCACATAGGTGGTAAAATAAGTACCACGGTAAAATTATGGCTTAGGGCTCAGGGTAAAA<br>TTATAAAAAAGGAACAGATTACATCCCACTGTGGGCAATAAGAAACACTTTCTGCAGGATTCT<br>GAGATGGGCCTGGAAGAATGGATGATATTTCAACAGGGGGTAATGAGGAAATGCAGTTTCG<br>GTGTGGGCACCTGAACGGACAAAAGG |
| 3335 | PTPRM | 3777536 | CTGGGAAACCTGCATCACCTAATTCACTGGAGAGGGATAATAGTGATGCTATAAATAGCAAA<br>TGAAGTCAGTTGGGCTCTTATATGTGTTGAGCACCACCATCCATCTGAATAGTTGCTTAAGCC<br>AGAAACTGGGGAGTGGCCCCAGCTGCTTCTTCCTTCCCTTCATCCAGAAAGTTAGCAGTTCCT<br>GGATTTTCCTCCTCTAGAATGTCCCTCAAACCTGTCCTCTTTTGTCTTTTCTCATGTCTGCCACAC<br>TTGTCTTAGTCATTAGCGAAATATCCACATTTTATACTTCTGTTTTGAAACTGACGGAATTGTCC<br>CAGAAAACTGATGTTTATGGTTTCTTTTAAATAAGTACAGAAATTTACCCTCCCAGTCTTAAAT<br>CTTGAGAAAGTTACATTTATCTTATCTGAGTTCCTTTTTCAGGAAACCAATCATCAGTCCTCCCA<br>GTCTTAAATCTTGAGAAAGTTACATTTATCTTATCTGAGTTCCTTTTTCAGGAAACCAACCATCA<br>GTCCTCCCAGATAGTATCAAGGAACTGAAACTTTCCAGATCACAGCATCAGGACAGTGAGAC<br>ACCACACCCCTCACCCAACATGATTGCCTAGCCCACCACCTACTGCCTGTTGGCTAACTCCTCT<br>TCCTTACCCTTTCCTGGTCTTGTTTTCCCACATGTCATTACGTTTCTTTCCTGCTGTGTAAATCCT<br>TAATTTTAGTTGGCTTAGGAGATGGATTTGAGACTGATCTCCCATTCTCCTCTGCCGCAGTACC<br>CGAATAAAGCCTGGCAATACTCTTTGTCCTAGTAATTGGCCTCCTGTGCGGCAGCAGTGACAC<br>CTATCTGTACCATACCTTTGACGCTTTGGGGGCAGTTCTGTGAAGGTGGGAAAATTGATTGTG<br>GAATAAAGTGATACATTTGGTTTGGGGCATGTTTCTATCTTATTAATAGTATATTTTTCCTCATA<br>GAGATGTCTACTACACAGTTAGAAATAAAGGCCTAAGCTGGGCATCATTGCCCTTGCCTGCAA<br>TCCCAGCTACTAGGTAGGTTGAGGTGGAAAGATCGCTCGAGGCCAGGATTTTGAGACTGTAG<br>TGTGCAATGAGCATGCCTGTGAATAGCCACTGCGCTCTAGCCGGGCAATAATAATATTA |
| 3336 | PTPRM | 3777558 | ATGCTGGTGAATGCCTCTGGGAGACCTGAGGGGC |
| 3337 | PTPRM | 3777559 | CCTCCGGGGTTACTCAATGTCTACGTGAAGGTCAATAACGGGCCACTGGGGAATCCTATCTG<br>GAATATATCTGGAGACCCAACACGTACATGGA |
| 3338 | PTPRM | 3777565 | AGTGATAACTTCTGGACATCAAGGCTATCTCGCTATCGATGAGGTGAAGGTGTTA |
| 3339 | PTPRM | 3777567 | CACTTCCTGCGGATTCAGAATGTGGAAGTTAATGCTGGCCAGTTTGCTACCTTCCAGTGCAGT<br>GCCAT |
| 3340 | PTPRM | 3777570 | AGGAAGGGCTGAGCATGCCTAGCCCAGCCCCTTCTTTGGGGAGCTGACTGCCT |
| 3341 | PTPRM | 3777573 | TGTGCGAGATGCTCCTCTGAAGGAAATCAAGGTGACCAGCTCCCGACGCTTCATTGCTTCATT<br>TAATGTTGTGAATACCACCAAACGAGATGCTGGAAAGTACCGCTGCATGATTCGCACTGAAG<br>GA |
| 3342 | PTPRM | 3777575 | AGCTCGCCTCTGTAGGAGCCACCTACCTGTGGATACAGCTCAACGCCAACTCCATCAATGGGG<br>ATGGGCCCATTGTGGCCCGAGAGGTGGAGTACTGCACGGCCAGTGGGAGCTGGAATGACCG<br>GCAGCCAGTCGATTCCACGAGCTATAAAATTGGACACCTTG |
| 3343 | PTPRM | 3777592 | TAAGACGGAGAGCATGCAGTCTGAGT |
| 3344 | PTPRM | 3777611 | AAGCACAACAGAGATGTGAGTCACAACACAGAAACTTGGAAAGGCTTTTCACAGA |
| 3345 | PTPRM | 3777616 | TGCGAGGCCCAAGAAAACTAGAAGTAGTGGAGGTCAAATCTCGGCAAATCACTATCCGCTGG<br>GAGCCATTTGGATATAATGTAACTCGTTGCCACAGTTATAATCTCACTGTCCACTACTGTTACC<br>AAGTTGGAGGACAAGAACAAGTGCGAGAAGAAGTAAGCTGGGATACAGAAAACTCACACCC<br>TCAACACACGATCACTAACCTGTCACCATACACCAATGTCAGTGTGAAACTGATCCTCATGAAC<br>CC |

TABLE 13-continued

Subtyping Target Sequences

| SEQ ID NO. | Gene | Affy Probeset ID | Sequence |
|---|---|---|---|
| 3346 | PTPRM | 3777617 | GTGGAGAGAACCAACTCAAACATATGGTGTAATCACTTTA |
| 3347 | PTPRM | 3777620 | AAGCAGTCAGTTCCTTTGACCCAGAAATAGATTTATCCAATCAGAGTGGAAGAGTTTCAAAGC TGGGAAATGAAACCCATTTTCTGTTTTTTGGACTGTATCCGGGGACCACATACTCCTTTACCAT CCGAGCTAGCACAGCTA |
| 3348 | PTPRM | 3777621 | CCCTCTATGCCAGCTTATGAACTTGAGACACCTTTGAATCAAACTGACAATACCGTGACAGTC ATGCTGAAACCTGCCCA |
| 3349 | PTPRM | 3777626 | CGACAGAAATCTTAAAGTGCTACCCAGTGCCAATTCACTTCCAGAATGCTTCTCTGCTGAACTC ACAGTACTACTTTGCTGCAGAATTTCCTGCAGACAGCCTCCAAGCTGCGCAGCCTTTTACAATT GGTGATAATAAGACATATAATGGATACTGGAACACTCCCCTTCTCCCCTATAAAAGCTACAGA ATTTATTTCCAAGCTGCTAGTAGAGCCAATG |
| 3350 | PTPRM | 3777629 | GAAACCAAAATAGACTGTGTCCAAGTGGC |
| 3351 | PTPRM | 3777631 | TTTCAATTGGAAACACTGCTCAGTCTTCACCTTTATTTAGGATGAATGTTTTGGTTTTGTTTTC CTTTTTTCTTCTTCAGTTGATCTATCCAAGATCTCAGCCAAACCTTGCAACTGTGTCATAGTTA GAAATCCAACTGCCTGACTAGAGCTTGTTTAAGGGAAAAGAATTCAGAATATTCAGCACCTTG CTATGTTTTTTTTTCTTTTTTTCCTTTTCTTTTTGTTGTTGTTAGAACAAAGTTGAGACAATTTG ATATACTGATGGGGATTCTTCTTGCTAGCCTAGCTTCAGTCTGGCTTTTTTTTCCCTCATGCATG CTGACCTGGAAATCCTC |
| 3352 | PTPRM | 3777632 | CTGCGATAATCGTGACTCAGCTTACAACACCTTACATTCGCATCGCCCCCGCTGCAGGCGACG GCCAACTAACA |
| 3353 | PTPRM | 3777634 | CCAGAACCCGAGAAACAGACAGACCATACAGTTAAAATTGCTGGAGTCATCGCGGGCATCTT GCTGTTCGTGATTATATTTCTTGGAGTTGTGTTGGTAATGA |
| 3354 | PTPRM | 3777637 | GGGAGGCATTGTCAATTATTAGCTAAGATTGTTTTGTCTTCTGAAGAATTGGCCCTCTATAAAA AAATAGTTGTGGAAGGTGGGCTTTTAACAGAAAATGTAAAGTCTGTTCAGTTCATACTAATTA GTACATGGAATTATTTAACATATAGGCAATAATGGCTAAAAACTGACATGACCATCAGCTTTA TTTTAGGATGTTTTACAAACCTATCACAAAGCAACAACTAATTTTTTGTTCATGTATATTAATTC ATTTGGCCTTTACCTGGACTAATATCATCTGAAACCTTCTTTTCTTTGAAACATTTTATGAAATG TATACACTTATTTTTACTTTATTATGTAAGCAAAGCAATTTTTATTTTCCGTCCCACAAATTATG TGTTCC |
| 3355 | PTPRM | 3777664 | GAAACTGGCCAAGAAGCGGAAAGAGACC |
| 3356 | PTPRM | 3777665 | TGAGCAGCACCCGACAGGAGATGACTGTGATGGTGAACTCAATGGACAAGAGCTATGCTGA GCAGGGCACAAACTGCGACGAGGCTTTCTCATTCATGGACACGCACAATCTGAATGG |
| 3357 | PTPRM | 3777672 | CCACGTTGTAGTGATCCAGGTGCCATTTCAGCAACAGCAACATAGCTACACACTTGTGTACCA CCTTTCATACCATGCATCCCCAGGTGCTTTGCGATGCAGATAGAAGTGAGGTTCCCAAACCAG GCCCTGCTCATCAAGCACCCTTGGACTAAATTTTCTTCA |
| 3358 | PTPRM | 3777673 | GAAACCCACACAATGGCCAGCGATACCAGCAGCCTGGTGCAGTCCCATACTTACAAGAAGCG AGAGCCGGCCGACGTGCCCTATCAGA |
| 3359 | PTPRM | 3777688 | CTGCACCATGGGACTCGGCTAAGAAAGATGAGAAC |
| 3360 | PTPRM | 3777697 | ACGATCATTCCCGAGTGAGGCTGCAGACAATAGAAGGAGACACAAACTCAGACTATATCAAT GGCAATTATATCG |
| 3361 | PTPRM | 3777710 | GGATGGTGTGGCACGAAAACACTGCAAGTATCATCATGGTGACCAA |
| 3362 | PTPRM | 3777729 | TACCCTAATAGAAACAGAACTACTGGCAGAATATGTGAT |
| 3363 | PTPRM | 3777735 | CCGAGAGATCAGACAGTTTCACTTCACTGGCTGGCCGGATCATGGGGTCCCCTACCATGCCAC CGGCCTGCTGGGATTCGTGCGGCAAGTCAAGTCCAAGA |
| 3364 | PTPRM | 3777736 | ACTGGCTGTTTCATCGTCATTGATATCATGTTGGACATGGCCGAAAGGGAAGGGGTCGTAGA CATCTACAACTGCGTCAGGGAGC |
| 3365 | PTPRM | 3777737 | AGGGTTATCTCTGTGCACTTTGTTCTTCTCCCAGGGTCCTGGGAAGAACAGAAGCCTCCTGAC CCTAAAAATTCTGCCCAGTGTCTGGCGTCCTGGGGATTTGCCCATTTTGTGAAGTACTGTATAC TAACTAGTAACTCTGTAAGTGGAAATTCAAGGTATATCGGGAATTTCCATTTTTTCAGAAGCA ATGTTACATCCTGCTCTTAGGACATTCGTATTTTTACTCATATTTGATTGTTTTAAGTAGGCGTC ACACCGACCACCTGGAAAATGATTCATGAAGTGAAGTGAAGAAGAAGTAAGAATCCCTTACA TTTAGATGGTGCATTTAAGTTTATGAAAGCCTCTGGGAAACCTAATCCCATTTTTTTAGCTAAC ATAAAAATAACAGAAACTTTAAATGCTGCTTTCATGGGTTCTTTTCCTTAGAAAGGGGATACT GTGTTTGAAAGATAATAATCGTAATAATTTATCTTTTAATGTACTTTATAGTCAATCAAATGTT GCCACTCGCATTTCTCACTTGGATCTTCCATTTTCAGGTGTTGTTTACTGGTAGTGTGCTGTTTT TGGGAATCAATCTGTTGGACAAGAGGGTTGTTGAAAAAAAATAATTAAAGGTCATATTTATGTA |

TABLE 13-continued

Subtyping Target Sequences

| SEQ ID NO. | Gene | Affy Probeset ID | Sequence |
|---|---|---|---|
| | | | TAGAAAAAACCGAATTAACTGTAATAAGAGGCTTTTTAAACTTCCCATATAACTAAAGATTAAT<br>AATAAATATGATAAGACTCTACCAATGAATTTTAAGAAAAGTCAGTGCCAAATCAGAATTAGA<br>GGCCCCATATTTACACTGTGAACTCATTGAAGATATATATGAGAACAGCTCTCTGTACTTCTAA<br>GAGGTTTCATAATCATATTAACTTTTATGTTCTGAAATAAGAACTTCTAAGTACTTTTATGTTTT<br>GAATTAAGAACTTCCAGACTTCTTGTCTTCACAGTAATGCCAAGTTTTTCTGGACCTTCTTTGCA<br>CTATTATTTTGACCAGCAAATCCTACCATAGACAAAATTCTGCTCATTCCTCATGTGAAATACT<br>GAGTTCCAAGTGAGTAGGATCAGAATGACAGAGGTCTTCAGCCACAGTTTTCATGGTGCTGC<br>AGTGCGTGTGGTGGTTTGTATTGGGTCCGATTGGTTTTAATCAATCTGTGTAATATTTGGCATT<br>GCACCCCAGTCTCCTAGCACTTGAGCCCTTGGACCGTGTTTC |
| 3366 | PTPRM | 3777738 | TCCACGATGCGATCCTGGAAGCCTGTCTTTGTGGGGACACCTCTGTGCCTGCTTCCCAAGTTA<br>GGTCTCTGTATTATGACATGAACAAACTGGATCC |
| 3367 | PTPRM | 3777740 | CATGGTGACACCAACGCTGCGAGTAGAGGACTGCAGCATCGCACTGTTGCCCCGGAACCATG<br>AGAAAAACCGGTGCATGGAC |
| 3368 | PTPRM | 3777742 | TTTTATAGTCACCCAGCATCCTTTGCCAAACACAGTGAAAGACTTTTGGAGACTGGTCCTGGA<br>TTATCACTGCACATCCGTAGTTATGCTAAATGATGTGGA |
| 3369 | PTPRM | 3777747 | TGGATATCGGATGGTGCAGCAATTCCAGTTCCTGGGCTGGCCGATGTACAGGGACACACCAG<br>TGTCTAAGCGCTCCTTCTTGAAGCTCATTCGCCAGGTGGACA |
| 3370 | PTPRM | 3777749 | TCGTATGTGAGATGCTCCGGCACCAGAGAACCGTGGATGTCTTTCACGCTGTGAA |
| 3371 | PTPRM | 3777752 | CTGCTGATGTTCAACCACCCTACAAGGAGCCCCCAAGCTTTCTCCCAGCCTAGAGGCTGGAC<br>ACCAGCGGGGCTCTCAGGGTTCATGATGTGTG |
| 3372 | PTPRM | 3777758 | ATCAGTACAAGTTCTGCTACGAGGTGGCCCTGGAATACTTGAATTC |
| 3373 | PTPRM | 3777759 | TACCACAAAGCCAAGACGTTCCATGGTATTTGTGCAAAAGAGATGAAGACTTCTCAATATGCT<br>TATTTTGCTTTGCATAATTGGCTCTTTTTAAGAGCCCAAGAAAGTGTTTCTAAAATTGCTTGCA<br>CTGCCCAATCCCAGTAATGCTGCTGCCTGACAGAAACACACACAGCCACAGTTGCCAAATC<br>CCGTACTCCTTGCCACCGGCTTCCTAGAGCAGCTAGACAGCTGGTAAACTGAAGAGCACAA<br>CTATATTCTTATGAAGGAATTTGTACCTTTGGGGTATTATTTTGTGGCCCGTGACCCTCGTTAT<br>TGTTACAGCTGAGTGTATGTTTTTGTTCTGTGGAGAATGCTATCTGGCATTATGGTAATATATT<br>ATTTTAGGTAATATTTGTACTTTAACATGTTGCATAATATATGCTTATGTAGCTTTCCAGGACTA<br>ACAGATAAATGTGTAATGAACAAAGATATGTTGTATGAGTCGTCGTTTCTGTCAGATTTGTAT<br>TGTTTCCAAGGGAAAAGCTTGGGGGAGGACTCAGTTCACAAAATGCAAAACTCAACGATCAG<br>ATTCACGGACCCAGAGCTTTT |
| 3374 | PTPRM | 3777760 | TTTGATTTCATCAAATTATTTATTCATTAAAAG |
| 3375 | PTPRM | 3777780 | GGATGGTTAATAGGACCTCAGGCTCCTGGTCAGTGTGGGGCACTCAGACCCATGAGTCTAGA<br>AAGCAAAGAACAACTGGATTCATGTTTCCTATGTCAGAGTCCACCCAGTTGCAGTTCCACCTG<br>AGTCCTTCA |
| 3376 | PTPRM | 3777782 | TGGCTGCACCGTTTGACATTCCCTCCAGCCGTGTATGAGGGTTCGCTTTCTCCACGCCCTCGCT<br>AACACCTGCGATTTTCTTGTTATGTGAGCCTTCTCGTGAATGTTATTCCACTGACATTAATCTCA<br>TGGCACCGTCAGTGATTGAAATGATCTTCTTGTTCTCTGTCTTCGCCTCTGGATCATGACCTTC<br>CCGAGGACTGAATGTGTCATAAAATCCCCAGTCTCTAGCAGTACATGTGTA |
| 3377 | PTPRM | 3777784 | CTTCCAGTTGCTAAGGCTCTGTCCAGGGCCGGGCTCCTGCCAGGTGGCAGGCAGAGGCTTCC<br>TCAAGCCCTGCGTCCCTCTTCTGGGTTCAGAGACCACTCCCAGGCTTGGTTCTATCAGCACACT<br>CCATGCATACAGGTGCAGAATGCTCTCCCCGGCCACCCGAGACCACACCTCAGCCAGGACCTT<br>GTGCAGAGCTTGCTTGGGCCAAGGTACACGATCCAGGAAAGCTGAGCTCAA |
| 3378 | RALBP1 | 3778412 | GTTGGAACGACTAAAGCACGCTGGCGCAAGGAAAGCTCTCAACTTCGGGAGCTGAGGCGCA<br>GGCTGGCCAGAGCGTGGAGAGGAAAGCCCTTTCCATCCTCAAGGCCGTTGCAGGAGATGCCC |
| 3379 | RALBP1 | 3778416 | GTGCTGCGATCCTTCCTTCAGGTTTCAGTGGGAATGGACAGACAGATCTGAAGTTGAAAATTC<br>TTTTCACAACTCATGTTCAACTATGTGTGTTGTCAGAATGCTCTTAATG |
| 3380 | RALBP1 | 3778417 | ACCGCGCCCTGCCAACAGTAGTAGC |
| 3381 | RALBP1 | 3778421 | GTCTTAAACTTTGAGCTCAGGCAGTCCACCCTCCT |
| 3382 | RALBP1 | 3778422 | ATTGTCTTTATCAGTCTAGTATGGAAACAAAATAATTGTGTACCAGGAGAACATGGAAATGT<br>AGTATAGTATAACTTACAAATGTTGTAGGGGTGAATGATCAAAAGCCACCTGGCATTTTGCTG<br>CTGGTATTCCTGCCCTTACTCCTCTCTTAGCCCCAGTTTTGTCACTTTCTGGCTTTGGAATTGGT<br>AATGACTCCCACACCAGGTCTGAACTCAACATGACATTTAGTGTCTGAGCCCACCTTATCTTTTA |
| 3383 | RALBP1 | 3778423 | GTGCCATAGGTAGTGTTAAATTTTGGAGCTCACCATTAGCAAGGTGAACACATGCATATGTAA<br>TTGAAATACAGTATGGTAAGTGCTGTGAAGAGGTATGTTCAGGATGTTCTAGGACACAGAAA<br>AGGAGTATTTGTGGCTTATACTGGATGGGGTGGGTCACCAGGGAGGATTCTTGGAGAAGTGT |

TABLE 13-continued

Subtyping Target Sequences

| SEQ ID NO. | Gene | Affy Probeset ID | Sequence |
|---|---|---|---|
| | | | TGCTAGTGCTTGATTTTTTAAACAGCTTTATTGAGGTAGAACTCATATAAGATCCACTCACTC GAAGTGTATAATTTAATGATTTTTAGCCAGTTTATGGGTTTCTGCAACCATCACCATAATCCAA ATTTAGAATGTTTCCATCATCTACAAAATCATGCCCAATTGTAGGCCTAGTGTTA |
| 3384 | RALBP1 | 3778425 | GTAACAGAGAAGACCTCGTCCCTTCCTAGTCAGGGCATCAGC |
| 3385 | RALBP1 | 3778426 | AGCATGGCAGCGGGCTTACCCGGACCCCCAGCTCTGAAGAGATCAGCCCTACTAAGTTTCCTG GATTGTACCGCACTGGCGAGCCCTCA |
| 3386 | RALBP1 | 3778427 | GTAGTGTCTGATGATGAGAAAGATCATGGGAAGAAAAA |
| 3387 | RALBP1 | 3778429 | CTGAAGGCTATGCAGCCTTTCAGGA |
| 3388 | RALBP1 | 3778430 | GTCCTTCTAAAATGAAGAGGTCCAAGGGAATCCATGTTTTCAAGAA |
| 3389 | RALBP1 | 3778431 | AAGACTTGACAGCAGCTGATGTTGTTAAACAGTGGA |
| 3390 | RALBP1 | 3778432 | GCCAGAGGTGCCTCAGATTGATGTTCCAAATCTCAAACCCATTTTTGGAATTCCTTTGGCTGAT GCAG |
| 3391 | RALBP1 | 3778433 | CGTGAATGTATAGATTACGTAGAGA |
| 3392 | RALBP1 | 3778435 | GTTTATTCTCTAACCTGTGGCAATGTGCTGTAGTCAGCCCGACTTATGCTACTGTCATGGACAG TGCTAATAATAATACTGCCTTTTGCTGGAGATGTTAGTTCTCACTTATGCATTTTAAGACCTTTT GCTGGAAGTGTTAGTTCTTGCTTATC |
| 3393 | RALBP1 | 3778436 | TGCAGGAATTCCAGCGTTTACTCAAAGAACTGCCAGA |
| 3394 | RALBP1 | 3778437 | GAAACCTCTGCGATGGTCTAACATGGC |
| 3395 | RALBP1 | 3778438 | CTTTTGAATTGTTTACATCGAGATCTGCAGGGTGGGATAAAGGATTTGTCTAAAGAAGAAAG ATTATGGGAAGTACAAAGAATTTTGACAGCCC |
| 3396 | RALBP1 | 3778439 | GATTGCACAAGAGATAGCCAGTCTTTCAAAAGAGG |
| 3397 | RALBP1 | 3778440 | GAAGAGATTGAACGCCTCAGAGCTGAGATTGCTGA |
| 3398 | RALBP1 | 3778441 | GAGACTGAGGAGTACTCCTCCGAGAGCGA |
| 3399 | RALBP1 | 3778443 | CCCAGAGACGGCGTCCTTGAGCCAAAAGCAGCTAAAGAGCAGCCAAAGGCAGGCAAGGAGC CGGCAAAGCCATCGCCCAGCAG |
| 3400 | RALBP1 | 3778444 | AGGACCCGTGCATCTTACTGTAACCCGGGGGCCAGGCCGGCTCTCTCGCTGTACATTCTGTAA AGGTGTCTTCTCTTCTCAGACTCTTCCTCTGTCACACGTCTGACTCCTTCACGTCAGGCTCAGGT TCCATGGGAGGACGAAGCAGTGGACGCATTGTGGGCTTTAGGGACAGATGAGTTTTCCAGAT AGTGTCAGCTTA |
| 3401 | RALBP1 | 3778445 | CTGGGATCTCTGGTACCGTCACTCTTGCTTGTGCCTTCCACACCTTCTCGGTGCAGATCCCTAT GGGGGAGCTGCCTCACGTTCTCTGACTGGTCAGAGCAGCGCCTG |
| 3402 | RALBP1 | 3778446 | TGGGTGTTCCCTGGCCCACTCTCCTCTCTCCTTCT |
| 3403 | RALBP1 | 3778447 | TTCTAAACCACAGTCTATAAGCCCGAGTCACCAGGACGGCCTGTCTGGCCACAGACAGGGGC TGCCTGTGGAGCCTGCCCACCGGCCCCCGGCAGTGCAGTCCAGCGGGGAGGAGGCTGCCCG TTCCTGCCAGTTC |
| 3404 | RALBP1 | 3778448 | ATCCACAGAGGATGTTGTTCAAACCAGAAATCTTTTAAACGACTGACCTTCCTTAAAAACAGA ATGACTCCGATTGCTTGCTTGGGCTAGAATGTACACGTCTCCTTGCCTGAATAAGCCATATATA TGCTCTTAAACAAAAGTTTGAAATTATCCATATCATCTCAGTGAACCTACTGGTGGACTCCCAA TTGACAAGATTGAGCAATAGAAAAAAATTCCTTTCCTTTGAATGATAGCTGTGATTCACCCCAC CCCATTTTCTTGTTTCTGGTCCATCCGATGAGA |
| 3405 | RALBP1 | 3778449 | CTGTGAGGAGATTGAGTACTCTGCAGCTGGCGAGGAGTTGGTTGAGGCACTTCTTCAAGGCC |
| 3406 | RALBP1 | 3778450 | CATGCTGGCGGCGGCATGCCTCCCTTCCACAAGCCCATGCTGCTGCAGAGGGAGCCTGTGTTT GCAAAACCCAGTGGACTGGGCTGGGTCTG |
| 3407 | RALBP1 | 3778451 | TGGGAACTGCACACAAGTCCACTGGCCTGGCTTGGCCCCAGGCATTGCAATTGACAGACATTT GCATTTCATACGGTAAATGAGGACTCAGCACAGCCAACCATAATCAGCATGTCTGGGATAGA |
| 3408 | SLC14A1 | 3786883 | TGAGTATATAACTGTTAGGTGCCTCCCTCCAGCACCATCTCCTGAGAAGCACTCTCCCTTGTCG TGGAGGTGGGCAAATCTTTATCAGCCACTGC |
| 3409 | SLC14A1 | 3786884 | TCTCCTGCTACTTAAAATCAAAAACTA |

TABLE 13-continued

Subtyping Target Sequences

| SEQ ID NO. | Gene | Affy Probeset ID | Sequence |
|---|---|---|---|
| 3410 | SLC14A1 | 3786886 | TCCCTGTGTAGGATGGCTTCCCGTTATTTTTTTTTAAGCAAAGTAAATGAACATCAAATTTCC<br>ATAGTCAGCTGCTGTCTTTCTGCCCACTGAGAGCTCTTTGGTGAAGGCAAAGTCCTCCTTCTTC<br>ATTAGCGGTCTCCCATGTGGGGCCACATCTTCCCTCACCAGGAACCCAGTGGGCGCGCTCCAG<br>CCCCCCTCAGCTTGCCTTTTGCGTGGTCATTAGAGCTAGGGCACACGTCATGCTGATTC |
| 3411 | SLC14A1 | 3786887 | GTAAGGATGAATGGACGGTCTTTGATTGGCGGCGCTGGTGACGCCCGTCATGGTCCTGTTTG<br>GAAGGACCCTTTTGGAACTAAAGCTGGTGACGCAGCGCGCAGAGGCATCGCCCGGCTAAGC |
| 3412 | SLC14A1 | 3786889 | CAGGGTCTGATGATTTTGGCGTTTCCCTGCTTCCCAATTGACCTGGCTGTGCTGTTGGCTGTTC<br>TTGCACACTCAAGGTGGTTTTGCCATTGGCTTCCTCCCTCAGCCTGCCTCTGGGATTATGCCAC<br>TGCTATTCTTTTTTATCTACCATCAGCACAATGAAATCATCATTTTTGTCTTCAAGGTACCAAAT<br>TCTGGTGATATTGGTGCTTTCTTGCAGCTACTTATCATGAGAAGTGAATGGTCTCATAGTGAA<br>CACAGTCATGGTTATAGTGTTCATACGTTCCAGAGACATGTTTCCTATAATTATGCCCTGCACA<br>TTTTTCTATCATACAATCCTTAGATTACAGCTCTTTGGTTTTCAACAGCTTTGTCCAATTCCATCT<br>TTCCCAGTTTCTCTACCTTGATGAAATATCCTTCTTGCCTGGTTTTACATATTTAAATAACAAAT<br>TCCAAAAGTAAAGAGTATCTGAGGCAGTCACATGACATAAGGACAAATTCAAGCCATCTTGG<br>ACTTGCAGAGGGTGGGGAGACCGTGTCAACACACACAATTTTAAAAATTTCTTCCCTTTCAAT<br>CTTTTAAAAACAAAACTTTTTATAAAATAAAAATGTAATTTAAAAAGGCTACCTGTCTTGGCAA<br>GTAGCTGATCAGCCTGCATTGGTGAGCAGGCCATTCCATAACCTGGTTTCTTGCTCCTTAATTG<br>ACAGCATGGAGCTAACGTACTTAATTTCAGCTCTTTCTACGTGATTTGACTCATTCTGTTAACA<br>TTAACTGTTTTTCAGTCTTCTCAACTAGACTGAACTCCTTAAGTGCAAGAAATACACGCTTAGT<br>AAATGTTTGTTGGACCAGACACTGCACCTTATGAAATTAAAGACCAGAACATTCTCATGGTAG<br>CATTACAGACACTGATGGCAAAGGTACTGTGGGATTTGGGTTTGGCTAATAAGCTCTGTGGT<br>GGTGTTTCAGAAGGAAAATGGTGCTCTCTTAGTTCTATGGAACATAGTGGTCCAGATCTTCTA<br>CTGTAACCAGGCCCAAAGCTGGCTAATCTGGAGGGCTCTGCCTTAGGGATACTTATA |
| 3413 | SLC14A1 | 3786890 | GGTTAGAGTGGACAGCCCCACTATG |
| 3414 | SLC14A1 | 3786891 | CAGGTTTCGCCATGTCAAGGGAGAAGGTGCTTCCCCAAAGCTCTTGGCTATGTCACCGGTGAC<br>ATGAAAGAACTTGCC |
| 3415 | SLC14A1 | 3786893 | AACCCGTGGTGCTCCAGTTCATTGACTGGATTCTCCGGGGCATATCCCAAGTGGTGTTCGTCA<br>ACAACCCCGTCAGTGGAATCCTGATTCTGGTAGGACTTCTTG |
| 3416 | SLC14A1 | 3786894 | CATCTGGGCTCTATGGCTACAATGCCACCCTGGTGGGAGTACTCATGGCTGTCTTTTCGGACA<br>AGGGAGACTA |
| 3417 | SLC14A1 | 3786896 | AGTGCATTGAATTCCATGCTCAGCAAATGGGACCTCCCCGTCTTCACCCTCCCTTTCAACATGG<br>CGTTGTCAATGTACCTTTCAGCCACAGGACATTACAATCCATTCTTTCCAGCCAAACTGGTCAT<br>ACCTATAACTACAGCTCC |
| 3418 | SLC14A1 | 3786897 | GAGTTGGTCAGATCTATGGCTGTGATAATCCATGGACAGGGGGCATTTTCCTGGGAGCCATC<br>CTACTCTCCTCCCCACTCATGTGCCTGCATGCTGCCATAGGATCATTGCTG |
| 3419 | SLC14A1 | 3786898 | TTGAGGACATCTACTTTGGACTCTGGGGTTTCAACAGCTCTCTGGCCTGCATTGCAATGGGAG<br>GAATGTTCATGGCGCTCACCTGGCAAACC |
| 3420 | SLC14A1 | 3786899 | CAATCAAGGATAAGCAGTAAAAACGGACTGCATGAAAAATCAGGGCCAGGGTTCTGGCTTGA<br>GCCCACTTGCTGTCTAAGTGTGTGAACAGGACAAGTGACGTCCCCTCTCTGAGAGCA |
| 3421 | SLC14A1 | 3786902 | GTTGGATTGCCAGCTTGTACCTGGCCCTTCTGTTTGGCCACGCTATTGTTCCTCATCATGACCA<br>CAAAAAATTCCAACATCTACAAGATGCCCCTCAGTAAAGTTACTTATCCTGAAGAAAACCGCA<br>TCTTCTACCTGCAAGCCAAGAAAAGAATGGTGGAAAGCCCTTTGTGA |
| 3422 | SLC14A1 | 3786903 | TGCAGCCATGGTCACGAGTCATTTCTGCCTGACTGCTCCAGCTAACTTCCAGGGTCTCAGCAA<br>ACTGCTGTTTTTCACGAGTATCAACTTTCATACTGACGCGTCTGTAATCTGTTCTTATGCTCATT<br>TTGTATTTTCCTTTCAACTCCAGGAATATCCTTGAGCATATGAGAGTCACATCCAGGTGATGTG<br>CTCTGGTATGGAATTTGAAACCCCAATGGGGCCTTGGCACTAAGACTGGAATGTA |
| 3423 | SLC14A1 | 3786904 | GTGTGTGTGACATTCTCTCATGGGACAATGTTGGGGTTTTTCAGACTGACAGGACTGCAAGA<br>GGGAGAAAGGAATTTTGTCAATCAAAATTATTCTGTATTGCAACTTTTCTCAGAGATTGCAAA<br>GGATTTTTTAGGTAGAGATTATTTTTCCTTATGAAAATGATCTGTTTTAAATGAGATAAAATA<br>GGAGAAGTTCCTGGCTTAACCTGTTCTTACATATTAAAGAAAAGTTACTTACTGTATTTATGAA<br>ATACTCAGCTTAGGCATTTTTACTTTAACCCCTAAATTGATTTTGTAAATGCCACAAATGCATA<br>GAATTGTTACCAACCTCCAAAGGGCTCTTTAAAATCATATTTTTTATTCATTTGAGGATGTCTTA<br>TAAAGACTGAAGGCAAAGGTCAGATTGCTTACGGGTGTTATTTTTATAAGTTGTTGAATTCCT<br>TAATTTAAAAAGCTCATTATTTTTTGCACACTCACAATATTCTCTCTCAGAAATCAATGGCATT<br>TGAACCACCAAAAAGAAATAAAGGGCTGAGTGCGTCCACGCCTGTAATCCCAGCACTT<br>TGGGGAGCCCAGGCGGGCAGATTGCTTGAACCCAGGAGTTCAAGACCAGCCTGGGCAGCAT<br>GGTGAAACCCTGTATCTACAAAAAATACAAAAATTAGCCAGGCATGGTGGTGGGTGCCTGTA<br>GTTCCAGCTACTTGGGAGGCTGAGGTGGGAAAATGACTTGAGCCCAGGAGGAGGAGGCTGC<br>AGTGAGCTAAGATTGCACCACTGCACTCCAACCTGGGCGACAAGAGTGAAACTGTGTCTCTC<br>AAAAAAAAAAAAAAAACAAACAAAAACAAAACAAAACAAAACAAAACAGGT |

TABLE 13-continued

Subtyping Target Sequences

| SEQ ID NO. | Gene | Affy Probeset ID | Sequence |
|---|---|---|---|
| | | | AAGGATTCCCCTGTTTTCCTCTCTTTAATTTTAAAGTTATCAGTTCCGTAAAGTCTCTGTAACCA
AACATACTGAAGACAGCAACAGAAGTCACGTTCAGGGACTGGCTCACACCTGTAATCCCAGC
ACTTTGGGAGATGGAGGTAAAAGGATCTCTTGAGCCCAGGAGTTCAAGACCAGCTTGGGCAA
CATAGCAAGACTCCATCTCTTAAAAAATAAAAATAGTAACATTAGCCAGGTGTAGCAGCACAC
ATCTGCAGCAGCTACTCAGGAGGCTGAGGTGGAAAGATCGCTTGTGCACAGAAGTTCGAGG
CTGCAGTGAGCTATATGATCATGTCACTGCACTCCAGCCTGTGTGACCGAGCAAGACCCTATC
TCAAAAAAATTAATTAATTAATTAATTAATTTAAAAAGGAAGTCATGTTCATTTACTTTCC
ACTTCAGTGTGTATCGTGTAGTATTTTGGAGGTTGGAAAGTGAAACGTAGGAATCCTGAAGA
TTTTTTCCACTTCTAGTTTGCAGTGCTCAGTGCACAATATACATTTTGCTGAATGAATAAACAG
AAATAGGGAAGTAAACCTACAAATATTTTAGGGAGAAGCTCACTTCTTCCTTTTCTCAGGAAA
CCAAGCAAGCAAACATATCGTTCCAATTTTAAAACCCAGTGACCAAAGCCTTTGGAACTATGA
ATTTGCA |
| 3424 | SLC14A1 | 3786905 | AGTGAAGAATCTAGGCTGTGGCTGAGAGAACCAGAGGCCTCTAAAATGGACCCGAGTCGATC
TTCAGAACAGGGATCTACCATGCAGGAGCTTCTTGTGCTCACACAAATCTGTAAATGGGAACA
TTGTACATTGTCGAATTTAAATGATATTAATTTTCTCAAGCTATTTTGTTACTATTTTCCTAAAA
TTGAATATTTGCAGGGAGCACTTATACTTT |
| 3425 | SERPINB13 | 3791851 | TTGACTTATGCTTCCTAGTTCGTTGCCCAGCCACCAC |
| 3426 | SERPINB13 | 3791854 | ACTTGGCGCCGTCAGCACTCGACTTGGGTTTGATCTTTTCAAAGAGCTGAAGAAAACAAATGA
TGGCAACATCTTCTTTTCCCTGTGGGCATCTTGACTGCAATTGGCATGGTCCTCC |
| 3427 | SERPINB13 | 3791855 | ACTCTGAAAAGAGACGAAGAGCTCAAGAATAAAGGCTGA |
| 3428 | SERPINB13 | 3791856 | TAAGAATAAAGGCTGAAGGAAAAGAG |
| 3429 | SERPINB13 | 3791857 | CCCTTAATATTGAGAAGAGACCTTAGGTGTAATGGACAATACCGCTATGATAGAACTGGTAAA
GGCTAATAGACA |
| 3430 | SERPINB13 | 3791858 | ATAAGCAAACTCACTAATGATTATGAACTGAACATAACCAACAGGCTGTTTGGAGAAAAAAC
ATACCTCTTCCTTCA |
| 3431 | SERPINB13 | 3791859 | CATGCATCTCTGGAACCTGTTGATTTTGTAAATGCAGCCGATGAAAGTCGAAAGAAG |
| 3432 | SERPINB13 | 3791861 | TCCTCAGCTGATAAGAGGCAAACTGGATGCTAACAGAGGCATCTGACCCCAGAGTCTGGACT
CTTAACCATGAACCTTAATTTATCCACTGGGATAAATAGGCGATGGGCAAAATGAGAACCTCC
CCGTCGATTCTGCCAGCAAACCCTTTGTCAGCAAGGCCCTCA |
| 3433 | SERPINB13 | 3791863 | GATGGCTCTATTAGTAGCTCTACCAAGCTGGTGCTGGTGAACATGGTTTATTTTAAAGGGCAA
TGGGACAGGGAGTTTAAGAA |
| 3434 | SERPINB13 | 3791864 | CCATATAAAAACAACGACCTAAGCATGTTTGTGCTTCTGCCCAACGACATCGATGGCCTGGAG |
| 3435 | SERPINB13 | 3791866 | TTACGATCTAGAGGCGGTCCTGGCTGCCATGGGATGGGCGATGCCTTCAGTGAGCACAAAG
CCGACTACTCGGGAATGTCGTCAGGCTCCGGGTTGTACGCCCAGAAGTTCCTGCACAGTTCCT
TTGTGGCAGTAACTGAGGAAGGCACCGAGGCTGCAGCTGCCACCGGCATAGGCTTTACTGTC
ACATC |
| 3436 | SERPINB13 | 3791867 | GTGTTTATAACCATCCTCGAAAGTGAAATGTCCTTTTCTTTGTGCCATGCGTAAGGTGAGTCAA
ACCAAACCTCATTGATAATCTCCCTTTGGTTTCCTTTGAAAGTAAATTGGTATCTTGTAGTTTTG
TGCACACGAAAGGAGAAAAGTCTCTCCAGTAAAGAGTACGAACTAGTAATTTTGGGGGGTC
TCTCTAATTCTGGTATTTTGACATGTTATAATACGCAAGTAAAATAAAACAATAGTTTACTCAG
CTCATGTTACTATTCCCCAACAGATATTGTGGCAAATCACACATAGGAAAGAGAATTTGGGAA
TACAGTAGCAAAACATAAATTAAAACTCAAATGCCAGGACAAAATAAAACAATATACCAGAT
GGGAGAGGATGCCCGTATTTTCATCTTCCATTCATAACATTATCCATTGTTAGATGCATAAGCATT
TTGATATTGTGTAATAAATGTGGTATTTGAGAAGATAAATGATGTAGTTGATCAGTATTCCTCC
TCTATCACCTTTTTAGACTTTGTAAGGTAAATATTTGGACTAACTTTTAGAAAAGTTTCCCTTTT
TTTCTCCATTTACATTTTTCTGGTTTTTTTTTTTTTGAGTGAGGTACGAGTATTACCAAATGAT
ATTTTCTGAAGATGCTTTTTGGAAAGCTCTGAATCTATACCTAATGCTCTTAATTATTGGCTTGT
TTCATTTTTTTCCTCCAGTTTTTAACAAGATCACATAACTGGCTTATTTTTAACAGCTTTGTCAAA
CTACAATTTACATGCCGTAAAATGTACACACTGTAATTTTATAATTCATTGACTTTTAGTAAATT
TCTAGCGTTATGCATCGCCACAATCCAGTTTTAGAATATTTCCATGACCCTAAGAAGTTTCCTC
ATGTCTATTAATATTCCCAATCCTAGGCACCACTGAGTTGTTTTCTGTCTTTATAAGTTTTTCTTT
CTACATCTTATATAAATGGAATCATAATACATGTAGTATTTTGTGTCTGGCGTCTTGCACTTAG
CATGGTG |
| 3437 | SERPINB13 | 3791868 | TTGGGGAGATTCCTAGGCTAGAAATTGCTGGGCCATATGAAAAATCAATAGTTAGCTTTGTAA
GAAACAGTCAAACTGTTTTCCAACGTGACATTTTATATTCCCACCAGGAATGTTTAAAACTAGT
GTCTTCAAATCCTCACCAACATCCAGGATTGTGTCTTTATGATTATAGCCATTTTTGTAGGTAC
AAAGTGGCATCTCATGGTGGTTTTAATTTGCATTTCCATAATATCTAATTAGGTTGAGCTTTTTT
TATGTGCTTATTGGCCATTTGTTTGACTTTGTTTGGTGAAATGTATACAAATCATTTGCTCATTT
TTAATTTGGGTTGTCTGTCTTGTCTTCTCATTTTATTGAGTTAAATGAGTTCTTAATAATCTCTG
GCTTACAAGTCCTTAATTTATCAAATATATGATACGTGGACATTTCCTC |

TABLE 13-continued

Subtyping Target Sequences

| SEQ ID NO. | Gene | Affy Probeset ID | Sequence |
|---|---|---|---|
| 3438 | SERPINB13 | 3791869 | AGACTCAACTCTGGCAGTGGGGTTCAGACATCAGACAAATTGAGGACTAGCTAAAACAGGGA AGAGTTGGAAGCACCTCTCCAGAAGACATGCCCACCAGTGTGCCATATCAGTTTACCCTTGCC ATGGCTACACCCAGAAGTTATGGATGAAGCTGCTATGGATGAAGCTGGAGGACATTATGCTA AGTGAAAAGTAATACACAAAAAGAAAAGTACTGAATGATCTCACTTAAATGTGTAATATAAA AAAGTCAAATACATAGAGAAAGAGAATAAAATGGTAACTATCAGGGATTGGGGAGATGCAG GGAGAGGGAGAAAAAATAGAGAGATATAGGTCAAAGGATCCAAAGTTGAAGATATGTAGG ATGAACGAGTCTAGAGCTCTAACGTACAAGACAAGGATGATGGTTAATAATAATGTATTATAT ATAAGATTTTTGTGAAAATAGTAGATTTAAGGTGCTCTTGCCACACATCAAAAAGGATAACT ATGTGAGATGACGGATATATGTTAATTTACTTCACTAGAGCAACCATTTCACTGTGTACATG |
| 3439 | ATP8B1 | 3809827 | AAGTCCTATTATTCGGCCGGGCGTGGTGGCTCAGGTCTGTAATCCCAGCACTTTAGGAGGCTG AGGAGGGGAGATCACCTGAGGCCAGGAGTTCGAGACCAGCCCAGCCAACATGGTGAAACCC TGTCTCTACCATAAATTAAAAATTAGCCGGGCTTGGTGGTGGGCACCCGTAATCCCACCTATTT GAGAAGCTGAAGCAGAAGAATCGCTTGAACCTGGGAGATGGAGGTTACAGTGAGCCGAGAT TGCGCCACTGCACTCCAGCCTGGGTGACAGAGCAAGACTCTGTCTTAAGAAAAATTTAAAAAT AGGCCGGGCATGGTGGCTCATGCCTGTCATCCTAGCACTTTGGGAGGCCAAGGCAGGTGGAT CACTTGAGGTCAGGAGACCAGCCCGGCCAACATGGTGAAACCCCATCTCTACTAAAAATACA AAATTAGCTGGAAATCGCTTGAACCTGGGAGGTGGAGGTTCCAGTGAGCCGAGATCGTGG CACTGCACTCCAACCTGAGCAACAGAGTGAGACACCAGCTCAAAAAAATTTTTTAATAATAA TAAAAGTCCTATTATTCAACTGGTTATGTACATTATGGTTGAAAGGGAACGTTTTAATCCAGTC TCAATCCAGGGCAATAGAATTACAAAGCATGTTGTATTTCAGTTCAAATGGTATTGTATTATAA AATTACAGTTACATTTTCCTTTCGGTGATCTTCAGCATAATTTCCCAGAGGCCCCTTTTTCCTCC CTATAGGCCATCTTATTAACAGATTTTAAAATTTATAGTAATGACAAATGACTTATCAGTGTTC ATCATCTGAAAGCTAAGTGGTTCGTTCAATCACTTTTTCAAAGTTGATAGTAGATTGCATGGTT TCATGTTTCCTCATATTGGTTTATTAATTCTATTTAATCAAGGAAAATAACTTCAGATTCCATAA AGTTTCAGTTTATTTTTAGTTTACTACTAGGTGAGATAGCACATTACATACTTTTACTATCAAAT ATTATTTTAGCAGCTTCCCATAGTACCAAATGATTTGATTCCCTACTCTCATTTTTTAAAGCATA TAAATATTTATGGGCTTAAAAAGGGGGTTTTTAAAAACTGAGGATATCAGTAATAAATTGCAG AATATTTTGCAAAGCTTTCTTTTGGAAAGCAAACTTTTGTGCCTGCCTATATGCAAAGTATTTT ATCAGGGACTTGAACAAAGACCTCACTCTTTTTCACTTGTCTTATGTCGAGAGAAAAGGTTATT GGCAGCCACATTCCTAAGACTG |
| 3440 | ATP8B1 | 3809828 | ACAAAGCACGTCTATTTTTTTATGAAAGACTCTCAGGACTTTG |
| 3441 | ATP8B1 | 3809829 | GTACAGGCGCACCGGGGACAGCTGA |
| 3442 | ATP8B1 | 3809830 | CAGAAGCATCGCAAGCGGTTGAAGGCGGAGGAGCAGTGGCAGCGACGGCAGCAGGTGTTC CGCCGGGGCGTGTCAACGCGGCGCTCGGCCTACGCCTTCTCGCACCAGCGGGGCTACGCGGA CCTCATCTCCTCCGGGCGCAGCATCCGCAAGAAGCGCTCGCCGCTTGATGCCATCG |
| 3443 | ATP8B1 | 3809833 | TGGTTAACTATCATCCTGGCTGTTGCTGTGTGCTTACTACCCGTCGTTGCCATTCGATTCCTGTC AATGACCATCTGGCCATC |
| 3444 | ATP8B1 | 3809834 | GGCTTGGATACTTCTTATTGGACTTTTGTGAATGCTTTTTCAATTTTTGGAAGCATTGCACTTTA TTTTGGCATCATGTTTGACTTTCATAGTGCTGGAATACATGTTCTCTTTCCATCTGCATTTC |
| 3445 | ATP8B1 | 3809835 | TGAGCCTCCGATTCCCTGGGTTATACATAGTGGGACAAAGAGACTTACTATTCAACTATAAGA GATTCTTTGTAAGCTTGTTGCATGGGGTCCTAACATCGATGATCCTCTTCTTCATACCTCTTGG AGCTTATCTGCAAACCGTAGGGCAGGATGGAGAGGCACCTTCCGACTACCAGTCTTTTGCCGT CACCATTG |
| 3446 | ATP8B1 | 3809837 | CGAGTGACTATTCCTTTGCTCAGTTCCGATATCTGCAGAGGCTACTGCTGGTGCATGGCCGAT GGTCTTACATAAGGATGTGCAAGTTCCTACGATACTTCTTTTACAAAAACTTTGCCTTTACTTTG GTTCATTTCTGGTACTCCTTCTTCAATGGCTA |
| 3447 | ATP8B1 | 3809838 | GCCCACATTGGCGTTGGAATAAGTGGACAAGAAGGA |
| 3448 | ATP8B1 | 3809841 | TGAAATTCTTCTCGAGAAAAGACCAAGAGAAATAAGATTCTGAAGCTGAAGTTCCCAAGAA CAGAAGAAGAAAGACGGATGCGGACCCAAAGTAAAAGGAGGCTAGAAGCTAAGAAAGAGC AGCGGCAGAAAAACTTTGTGGACCTGGCCTGCGAGTCAGCGCAGTCATCTG |
| 3449 | ATP8B1 | 3809842 | ATAGAGGTGGCGTCTACGCAAAGTTTGCACCTCCTGTGCAGGAATCTTTTTTTCCACCCGGTG GAAACCGTGCCTTAATCATCACTGGTTCTTGGTTG |
| 3450 | ATP8B1 | 3809844 | AAATATAGGATTTGCTTGTGAACTTCTGACTGAAGACAC |
| 3451 | ATP8B1 | 3809846 | GCTACAGCTATTGAAGACAAGCTACAGGATGGAGTTCCAGAAACCATTTCAAAACTTGCAAA AGCTGACATTAAGATCTGGGTGCTTACTGGAGACAAAAAGG |
| 3452 | ATP8B1 | 3809847 | TCCACCAACCGGGACGAAGCTCTGGATAAAGTATATGAGG |
| 3453 | ATP8B1 | 3809848 | TCTTTGCAAATGAAACTCTTAGAACCCTATGCCTTTGCTACAAG |

TABLE 13-continued

Subtyping Target Sequences

| SEQ ID NO. | Gene | Affy Probeset ID | Sequence |
|---|---|---|---|
| 3454 | ATP8B1 | 3809849 | AGGCAATATCAAGCTTTACTGTAAAGGTGCTGACACTGTTATTTATGAACGGTTACATCGAATGAATCCTACTAAGCAAGAAACACAG |
| 3455 | ATP8B1 | 3809850 | GAAGGTGCCCTGGTAAACGCTGCCAGGAACTTTGGCTTTGCCTTCCTCGCCAGGACCCAGAACACCATCACCATCAGTGAACTGGGCACTGAAAGGACTTACAATGTTCTTGCCATTTTGGACTTCAACAGTGACCGGAAGCGAATGTCTATC |
| 3456 | ATP8B1 | 3809853 | GAAAGAGCCAGAAGTACGACAGTTCTTCTTCTTGCTCGCAGTTTGCCACACAGTCATGGTGGATAGGACT |
| 3457 | ATP8B1 | 3809855 | TCGGGATGCCTCTCAACACAACCACAACA |
| 3458 | ATP8B1 | 3809858 | GGGACCTGCAAATGTACTATGCTGAGAAGGACACACCCGCAAAAGCTAGAACCACCACACTCAATGAACAGCTCGGGCAGATCCATTATATCTTCTCTGATAAGACGGGGACACTC |
| 3459 | ATP8B1 | 3809860 | CTGGTCTTGCCATCGGCCATGCTTATTGGGAAGCACAGGTGGGCAATTCCTCTTGGTACCTCTATGATGGAGAAGACGATACACCCTCCTACCGTGGATTCCTCATTTTCTGGGGCTATATCATTGTTCTCA |
| 3460 | ATP8B1 | 3809864 | GAACACCGATTTCTGCCACGGCTTAGTCATTTTTGCAG |
| 3461 | ATP8B1 | 3809865 | TTGAATGTGAAGAACCCAATAACAGACTAGATAAGTTTACAGGAACACTATTTTGGAGAAACACAAGTTTTCCTTTGGATGCTGATAAAATTTTGTTACGTGGCTGTG |
| 3462 | ATP8B1 | 3809866 | TTTAAGATGTCACTTGAAATCACAGA |
| 3463 | ATP8B1 | 3809869 | GTCTAGCTCTGAGCCTAACAGCCTCTGCTATGTGGAAACAGC |
| 3464 | ATP8B1 | 3809871 | AATTCAAGTTGGAGACGTCATTCGTCTGAAAAAA |
| 3465 | ATP8B1 | 3809872 | AGGAAATCAACAATAGGACGTGTGAAGTCATTAAGGA |
| 3466 | ATP8B1 | 3809874 | TTAAACATACAAGTACAACGCATTTACCTTTATACCAATGAATCTGTTTGAGCAGTTTAAGAGAGCAG |
| 3467 | ATP8B1 | 3809875 | GGCAAGTCAAAGCAAACGATCGCAAGTACCACGAACAACCTCACTTTATGAACACAAAATTCTTGTGTATTAAGGAGA |
| 3468 | ATP8B1 | 3809880 | ACATTTGACGAGGATTCTCAGCCTAATGACGAAGTGGTTCCCTACAGTGATGATGAAACAGAAGATGAACTTGATGACCAGGGGTCTGCTGTTGAACCAGAACAAAACCGAGTC |
| 3469 | ATP8B1 | 3809881 | GCTTGATCACCCCAGTGTACTCCAGCCTAGGTGACAGAGCAAGAACTTGAATCAACAACCAAAAAAAAAAAAAAAGGAAGAAAAAAGAAGCAAACCACCTCATGTGTATGCCACACTCACAGGAAATTAA |
| 3470 | ATP8B1 | 3809912 | ATGCCCCAGCCGGGGCCCAGCGAACGCCAG |
| 3471 | SERPINB4 | 3811575 | TTTAGAAAATGTTCACCTAGAGGTGTTCTGGTAAACTGATTGCTGGC |
| 3472 | SERPINB4 | 3811576 | TGAATATCTTCAATGGGGATGCAGACCTCTCAGGCATGACCTGGAGCCACGGTCTCTCAGTATCTAAAGTCCTACACAAGGCCTTTGTGGAGGTCACTGAGGAGGGAGTGGAAGCTGCAGCTGCCACCGCTGTAGTAGTAGTCGAATTATC |
| 3473 | SERPINB3 | 3811576 | TGAATATCTTCAATGGGGATGCAGACCTCTCAGGCATGACCTGGAGCCACGGTCTCTCAGTATCTAAAGTCCTACACAAGGCCTTTGTGGAGGTCACTGAGGAGGGAGTGGAAGCTGCAGCTGCCACCGCTGTAGTAGTAGTCGAATTATC |
| 3474 | SERPINB4 | 3811577 | GAAATACCATACAAAGGCAAAGATCTAAGCATGATTGTG |
| 3475 | SERPINB3 | 3811577 | GAAATACCATACAAAGGCAAAGATCTAAGCATGATTGTG |
| 3476 | SERPINB4 | 3811578 | ATTCCTTTAATTTTGCCTTGCTGGAG |
| 3477 | SERPINB3 | 3811578 | ATTCCTTTAATTTTGCCTTGCTGGAG |
| 3478 | SERPINB4 | 3811580 | TGGCAATGATACGACACTGGTTCTTGTGAACGCAATCTATT |
| 3479 | SERPINB3 | 3811580 | TGGCAATGATACGACACTGGTTCTTGTGAACGCAATCTATT |
| 3480 | SERPINB4 | 3811584 | TTAGATGCCATCAAGAAATTTTACCAGACCAGTGTGGAATCTACTGATTTTGCAAATGCTCCAGAAGAAAGTCGAAAGAAGATTAACTCCTGGGTGGAAAGTCAAACGAATG |
| 3481 | SERPINB3 | 3811584 | TTAGATGCCATCAAGAAATTTTACCAGACCAGTGTGGAATCTACTGATTTTGCAAATGCTCCAGAAGAAAGTCGAAAGAAGATTAACTCCTGGGTGGAAAGTCAAACGAATG |

TABLE 13-continued

Subtyping Target Sequences

| SEQ ID NO. | Gene | Affy Probeset ID | Sequence |
| --- | --- | --- | --- |
| 3482 | SERPINB4 | 3811585 | GTTTCAAAAGCTTCTGACTGAATTCAACAAATCCACTGATGCATATGAGCTGAAGA |
| 3483 | SERPINB3 | 3811585 | GTTTCAAAAGCTTCTGACTGAATTCAACAAATCCACTGATGCATATGAGCTGAAGA |
| 3484 | SERPINB4 | 3811586 | TCAGCTTTAGATCCCTGAACAGGTC |
| 3485 | SERPINB3 | 3811586 | TCAGCTTTAGATCCCTGAACAGGTC |
| 3486 | SERPINB4 | 3811587 | CACAGAAAAGCTGCAACATATCAT |
| 3487 | SERPINB3 | 3811587 | CACAGAAAAGCTGCAACATATCAT |
| 3488 | SERPINB4 | 3811589 | CAACACTGCACAACAAATTAGCAAG |
| 3489 | SERPINB3 | 3811589 | CAACACTGCACAACAAATTAGCAAG |
| 3490 | SERPINB4 | 3811591 | TTCATTCCACAGACACACACAGCCTCTCTGCCC |
| 3491 | SERPINB3 | 3811591 | TTCATTCCACAGACACACACAGCCTCTCTGCCC |
| 3492 | SERPINB3 | 3811597 | AAAATGTTCACCTGCAGATGTTCTGGTAAACTGATTGCTGGC |
| 3493 | SERPINB3 | 3811598 | TAGGATTCGGATCATCACCTACTTCAACTAATGAAGAGTTCCATT |
| 3494 | SERPINB3 | 3811599 | ATGGTGGATATCTTCAATGGGATGCAGACCTCTCAGGCATGACCGGGAGCCGCGGTCTCGTGCTATCTGGAGTCCTACAC |
| 3495 | SERPINB4 | 3811600 | AATTGATGGAATGGACAAGTTTGCAGAATATGAGAGAGACACGTGTCGATTTACACTTACCTCGGTTCAAAGTGGAAGAGAGCTATGACCTCAAGGACACGTTGAGAAC |
| 3496 | SERPINB3 | 3811600 | AATTGATGGAATGGACAAGTTTGCAGAATATGAGAGAGACACGTGTCGATTTACACTTACCTCGGTTCAAAGTGGAAGAGAGCTATGACCTCAAGGACACGTTGAGAAC |
| 3497 | SERPINB4 | 3811601 | GAAATACCATACAAAGGCAAAGATCTAAGCATGATTGTG |
| 3498 | SERPINB3 | 3811601 | GAAATACCATACAAAGGCAAAGATCTAAGCATGATTGTG |
| 3499 | SERPINB3 | 3811602 | TGATGAGGCAATACACATCTTTTCATTTTGCCTCGCTGGAG |
| 3500 | SERPINB3 | 3811603 | GTAATATTGGCAGCAATACCACATTGGTTCTTGTGAACGCAATCTATT |
| 3501 | SERPINB4 | 3811608 | ATGCTCCAGAAGAAAGTCGAAAGAAGATTAACTCCTGGGTGGAAAGTCAAACGAATG |
| 3502 | SERPINB3 | 3811608 | ATGCTCCAGAAGAAAGTCGAAAGAAGATTAACTCCTGGGTGGAAAGTCAAACGAATG |
| 3503 | SERPINB4 | 3811609 | GTTTCAAAAGCTTCTGACTGAATTCAACAAATCCACTGATGCATATGAGCTGAAGA |
| 3504 | SERPINB3 | 3811609 | GTTTCAAAAGCTTCTGACTGAATTCAACAAATCCACTGATGCATATGAGCTGAAGA |
| 3505 | SERPINB3 | 3811610 | CCACAGGAAAAGCTGCAACATATCAT |
| 3506 | SERPINB3 | 3811612 | TGTTCGACCTGTTCCAACAGTTCAGAA |
| 3507 | SERPINB3 | 3811614 | GAGGAGAGGCATAAATTCAGGATCTCACCCTTCATTCCACAG |
| 3508 | CASP14 | 3822977 | GCCTTGAGGAACAGCTGCCTCTAGAGT |
| 3509 | CASP14 | 3822981 | GGTGCTGAGAGCCGGGACTCACAACCAAAG |
| 3510 | CASP14 | 3822984 | AAATATGATATGTCAGGTGCCCGCCTGGCCCTAATACTGTGTGTCACCAAAGCCCGGGAAGGTTCCGAAGAAGACCTGGATGCTCTGGAACACATGTTTCGGCAGCTGAGATTCGAAAGCACCATGAAAA |
| 3511 | CASP14 | 3822985 | CAATTCCAGGAAGAGCTGGAAAAATTCCAG |
| 3512 | CASP14 | 3822986 | CAGGCCATCGATTCCCGGGAAGATCCCGTCAGTTGTGCCTTCGTGGTACTCATGGCTCACGGGAGGGAAGGCTTCCTCAAGGGAGAAGATGGGGAGATGGTCAAGCTGGAGAATCTCTTCGAGGCCCTGAACAACAAGAACTGCCAGGCCCTGCGAGCTAAGCCCAAGGTGTACATCATACAGGCCTGTCGA |
| 3513 | CASP14 | 3822987 | TACCTTTCTCTCTGACTTTGCCTCCTCCTCTTCTTGTTGTTTCAG |

TABLE 13-continued

Subtyping Target Sequences

| SEQ ID NO. | Gene | Affy Probeset ID | Sequence |
|---|---|---|---|
| 3514 | CASP14 | 3822988 | GGTCATCAAAGACAGCCCACAAACCATCCCAACATACACAGATGCCTTGCACGTTTATTCCAC GGTA |
| 3515 | CASP14 | 3822989 | GAAAGGCTCATGCTTTATCCAGACCCTGGTG |
| 3516 | CASP14 | 3822992 | GTGACCCGGCGGATGGCAGAAGCAGAGCTGGTTCAAGAAGGAAAAGCAAGGAAAACGAAC CCTGAAATCCAAAGCACCCTCCGGAAACGGCTGTATCTGCAGTAG |
| 3517 | CASP14 | 3822993 | CTTCCAGCATTCTTTCTGTCTCACAGAAATTTAGAGGCAGCTCTTACCTCTCCCCAAGATCTTCT GTTCCCAAGGCCAAATGGCACCCAGTTTCTTTTCCATCACACCCTTCATGCAGGTCCTCCTGTC CTTATTAGAGCAAGCCAGCCAA |
| 3518 | CASP14 | 3822995 | ACTCCGTTCTCTTCCTAGCTCATGGCCTCTCTAGATAATAAAGTTGTCTCCTCCTTTCTGGATCT CTTCCTCCTAACACCCCTCCCCTGAAACCCTGGACTCTGCCCTCTCTCCAAGAAAATCCATCTAT TCAACTATTCTTGCATTCAATTACTCTAAATGAGAGCGTGTTGGAGCTATGGCAAATTCCCTGT TGTCACCTTGCTATTTTGCAGACAACATAATATTTAACCTCTCATAACCAGAGAGGTTAAATAA TTTGTCAAATGCAATACAGTAAGACAGAGGCAAGGACAAGGTTTGACTTCCAGCCCAGCCTCT TTTCCACAACCTGCTAAATCCTGATCCATCTGAAAACTTTTCTAATTAGTGAAGATGACTAATA AAAATTTTCCCTATCTCCAAGGTAGGAGCTTTCTGGAAGTTTCTAGAAATTTTCAATAACCACC AGCCAAGGTTACCTCCAGGTAACCTTGCAGCACCAGGCTGGAAGTCAGATCGGCTTCACTATC TTCCAACTCTACAGCCTGTATCTCTCCATCCCCAGCTTTGACCTTTCCTGCTCAAGTAACCTACG GGCACATCCAGCGTCACTAAAAA |
| 3519 | CASP14 | 3822997 | TAAGCCTTTGCTATCACCATTTCCCCAAGCTGGAGGGCCCTCCCTCTCCCTTTACCCCTCTTCC ACTACCTCCCACCCCTACTTTTTCCAGAAAGCCATTTCCTCTCTTTTTTCTGATTGATCCTTCCCT CTCACCCAGGATTAGATGCTGGAAATGACCACTTCTGGAGGGCAGGGAACAAGCCCTTAATC TG |
| 3520 | IFI30 | 3824875 | CCGCCGCCTGGTTAAAGGCGCTTATTTCCCAGGCAGCCGC |
| 3521 | IFI30 | 3824878 | CCCTGAAGAAGTCCAATGCACCGCTTGTCAATGTGACCCTCTACTATGAAGCACTGTGCGGTG GCTGCCGAGCCTTCCTGATCCGGGAGCTCTTCCCAACATGGCTGTTGGTCATGGAGATCCTCA ATGTCACGCTGGTGCCCTACGGAAAC |
| 3522 | IFI30 | 3824880 | GCCTGCGTGTTGGATGAACTTGACATGGAGCTAGCCTTCCTGACCATTGTCTG |
| 3523 | IFI30 | 3824881 | AGGGCTGTCGCCAGACACTATCATGGAGTGTGCAATGGGGGACCGCGGCATGCAGCTCATG CACGCCAACGCCCAGCGGACAGATGCTCTCCAGCCACCACACGAGTATGTGCCCTGGGTCAC CGTCAATG |
| 3524 | IFI30 | 3824882 | AGAATCTTTTTAGCCCTCAGCTTGACACTCATAGTCCCATGGAGTCAGGGATGGACAAGACAG AGGGACCAGAGATAAAGGAACCCAGGCGGAGGTTGCAGTGAGCTGAGATCATGCCACTGCA CTCCAGCCTGGGCAACAAGAGCAAAACTTGATAGCTTTGCATAGGGAAAGAGGGCATTGATG CTGGGGTTTTGAAAGGTGAGTAGGAGTCCATCAGGCAAAAAAGTATGTATTAATTCGAAGT ATTAAACATCCCTAGCCACCCCCATTGGGAAAGATGTGCCACTGATTTGCGAGGCGGGAGGC GGGGGCCAGACTTGGGAATATGTGCAGCCCTTTC |
| 3525 | IFI30 | 3824883 | AAACCCTTGGAAGATCAGACCCAGCTC |
| 3526 | IFI30 | 3824885 | CAAGAAGCCGGATGTCTGCCCTTCCTC |
| 3527 | IFI30 | 3824886 | GGCCGGTGAGCTGCGGAGAGCTCATGGAAGGCGAGTGG |
| 3528 | IFI30 | 3824887 | TCGGCACCTGCTACTTACCAACTGGAAAATTTTATGCATCCCATGA |
| 3529 | IFI30 | 3824888 | CAGATACACAAAATTCCACCCCATGATCAAGAATCCTGCTCCACTAAGAATGGTGCTAAAGTA AA |
| 3530 | ZNF486 | 3826181 | TCATTGCAATTTAGAGATGTGGCTGTAGAA |
| 3531 | ZNF486 | 3826182 | GTATTATTGTCTCTAAGCCAGACCTGATCACCTGTCTGGAGCAAGGAATAAAACCTCTGACT |
| 3532 | ZNF486 | 3826184 | TTGAAATATATAGAAGGTGACAAAGCT |
| 3533 | ZNF486 | 3826185 | AGTACTTCTCTAGCTTTACTACACATAAGAAAATTCATAGTGGAGAGAAACCCTACATTTGTG AAGAATGTGGCAAAGCCTTTATGTACCCCTATACCCTTACTACACATAAGATAATCCATACTGG AGAGCAACCCTACAAATGTAAAGAATGTGACAAAGCTTTTAACCATCCTGCAACTCTTTCTTCA CATAAGAAAATTCATACTGGAGAGAAACCGTACACGTGTGATAAATGTGGCAAAGCCTTTATT TCATCCTCGATCCTTAGTAAACATGAGAAGATTCATACGGGGAGAAAACCCTACAAATGTGAA GAATGTGGCAAAGCCTTCACCCGCTCCTCACACCTTACTATGCATAAGATAATTCATACTGGA GAGAAACCATACAAATGTGAAGAATGTGGCAAAGCCTTTACATGGTCTGCAGGCCTCCATAA ACATAGGAGAACTCATACTGGAGAGAAACCCTACAAATGTGAAGAATGTGGCAAAGCGTATA CTACATCCTCAAATCTAACTGAACATA |

TABLE 13-continued

Subtyping Target Sequences

| SEQ ID NO. | Gene | Affy Probeset ID | Sequence |
|---|---|---|---|
| 3534 | ZNF486 | 3826186 | GGTTCATAAAAGAGCAATTACTGTGACAAAAATCTTTCAGAAAATATAAGCCTTTAAGGTGAAGAAGAGTATTGATTCTGAAGACAAGCATTACAAATATAAAGAGGTTTGTAGTACCTTTGCTTGTATTACAGATCTTATTGCCCGCGTTTTGTATTAGAAGGAAACCCTAAAGCGGTTGCCAAACTTTGTG |
| 3535 | ZNF486 | 3826187 | TGAGATCAGACTGACCAAAACGGAGAAACCCAGTCTCTACTGAAAATATAAAATTAGCCATGCATGGTGGCACATGCCTGTAATCCCAGCTACTCAGGAGGCTTGAACCCTGGAGGCAGAGGTTGTGGTGAGTCGAGATCATTGCACTCCAGCCTGGGCAATAAGAGTGAAACTCTGTCTCCAGGAAAAAAAAAAATTTATTTGTGTATAACTTTAAAAGCAGATTTTTGGAAGCATTGTAATT |
| 3536 | UPK1A | 3830664 | GTCCCTGTTTGCTGAGACCATATGGGTGACAGCCGACCAGTACCGTGTATACCCACTGATGGGAGTCTCAGGCAAGGATGACGTCTTCGCTGGTGCCTGGATTGCCATCTTCTGCGGCTTCTCCTTCTTCATGGTAGCCAGTTTTGG |
| 3537 | UPK1A | 3830665 | TGGTGCTCATGCTCATCGTCTACATCTTCGAGTGCGCCTCCTGCATCACGTCCTACACCCACCGTGACTA |
| 3538 | UPK1A | 3830666 | ATGGTGTCCAACCCATCCCTGATCACCAAGCAGATGCTGACCTTCTACAGCGCGGACACCGACCAGGGCCAGGAGCTGACCCGCCTCTGGGACCGCGTCATGATT |
| 3539 | UPK1A | 3830668 | AGAATGCTGTGGCACATCTGGTCCCATGGACTGGGTGAACTTCACGTCAGCCTTCCGGGCGGCCACTCCGGAGGTGGTGTTCCCCTGGCCCCACTGTGCTGTCGCCGGACGGGAAACTTCATCCCCCTCAACGAGGAGGGCTGCCGCCTGGGGCACATGGACTACCTGTTCA |
| 3540 | UPK1A | 3830669 | ACGCCATCGACAGCTACACGTGGGGTATCTCGTGGTT |
| 3541 | UPK1A | 3830670 | GATAGCCATGTATTTCTACACCATGC |
| 3542 | UPK1A | 3830671 | GAGGGGAAGGCAACATACACACCCCGGACTCCTCCGCATC |
| 3543 | UPK1A | 3830672 | CCACTTCCAAGATCTTTTTCCAGGTTCCTGAGCCCTACTGTGTCTCAG |
| 3544 | UPK1A | 3830673 | GTGCACATATCCTTAGCCCATCTTTCAAGGGACCTCTCCATGATCCCACCTCCCATTCACAGATACCTCTCTTGTAGCTCTCTGACCTCCTC |
| 3545 | UPK1A | 3830674 | GCATCGCCATTCTTGCTGAACCGTTTGT |
| 3546 | UPK1A | 3830675 | TCTGGAAGCCTCTATTGCCATGAGAGTTCTGTCACGGTCACTTTACTGTCCCCATCATCACCCAGCACGGGGCTAAGCATATACTAGATAGTC |
| 3547 | IGFL1 | 3836693 | CCCATGACTCCTTACCTGATGCTGTGCCAG |
| 3548 | IGFL1 | 3836694 | AGATGTGGGGACAAGTTCTACGACCCCCTGCAGCACTGTTGCTATGATGATGCCGTCGTGCCCTTGGCCAGGACCCAGACGTGTGGAAACTGCACCTTCAGAGTCTGCTTTGAGCAGTGCTGCCCCTGGACCTTCATGGTGAAGCTGATAAACCAGAACTGCGACTCAGCCCGGACCTCGGATGACAGGCTTTGT |
| 3549 | IGFL1 | 3836695 | TTCTGTGACCTGTCTGAGGCCCACCCTGCAGCTGCCCTGAGGAGGCCCACAGGTCCCCTTCTAGAATTCTGGACAGCATGAGATGCGTGTGCTGATGGGGGCCCAGGGACTCTGAACCCTCCTGATGACCCCTATGCCAACATCAACCCGGCACCACCCCAAGGCTGGCTGGGGAACCCTTCACCCTTCTGTGAGATTTTCCATCATCTCAAGTTCTCTTCTATCCAGGAGCAAAGCACAGGATCATAATA |
| 3550 | CGB2 | 3838162 | CCTTCCAAGCCCATCCCGACTCCCGGGGCCCTCAGACACCCCGATCCTCCCACAATAAAGGCTTCTC |
| 3551 | MYADM | 3841081 | CTGCCGCTGTCGTCTTTGCTTCAGCCGCAGTCGC |
| 3552 | MYADM | 3841082 | CCCGCGGGGTTAAGATCACACACGCGCCCACGCCGGCCCGCGGGGCGTGCACTTTCGCTGGGTTCCGTCCGCCGCAG |
| 3553 | MYADM | 3841083 | TGCTGGGTTCCACGCCACGTTCCTGTCTCCGCAG |
| 3554 | MYADM | 3841084 | CGTTCGATCCCTAGAGGGAGGAGCCTGTCCAAACGGACGCTAACGGCCTACCTCCCCCTCAG |
| 3555 | MYADM | 3841085 | TGCTCTTACAGCCTGTTCCAAGTGTGGCTTAATCCGTCTCCACCACCAG |
| 3556 | MYADM | 3841088 | ATGCCAGTGACGGTAACCCGCACCACCATCACAACCACCACGACGTCATCTTCGGGCCTGGGGTCCCCCATGATCGTGGGGTCCCCTCGGGCCCTGACACAGCCCCTGGGTCTCCTTCGCCTGCTGCAGCTGGTGTCTACCTGCGTGGCCTTCTCGCTGGTGGCTAGCGTGGGCGCCTGGACGGGGTCCATGGGCAACTGGTCCATGT |
| 3557 | MYADM | 3841089 | TTCTCCGTGACCCTGATCATCCTCATCGTGGAGCTGTGCGGGCTCCA |

TABLE 13-continued

Subtyping Target Sequences

| SEQ ID NO. | Gene | Affy Probeset ID | Sequence |
|---|---|---|---|
| 3558 | MYADM | 3841090 | CTGCATCGCGTGTGTGGCTTACGCCACCGAAGTGGCCTGGACCCGGGCCCGGCCCGGCGAGA TCACTGGCTATATGGCCACCGTACCCGGGCTGCTGAAGGTGCTGGAGACCTTCGTTGCCTGCA TCATCTTCGCGTTCATCAGCGACCCCAACCTGTACCAGCACCAGCCGGCCCTGGAGTGGTGCG TGGCGGTGTACGCCATCTGCTTCATCCTAGCGGCCATCGCCATCCTGCTGAACCTGGGGGAGT GCACCAACGTGCTACCCATC |
| 3559 | MYADM | 3841091 | CCTCGGCGCTCGAGAGATGTAAGCTGCAGCCGCAGCCATGCCTACTACGTGTGTGCCTGGGA CCGCCGACTGGCTGTGGCCATCCTGACGGCCATCAACCTACTGG |
| 3560 | MYADM | 3841092 | ATGTGGCTGACCTGGTGCACTCTGCCCACCTGGTTTTTGTCA |
| 3561 | MYADM | 3841093 | ATGGAGTACTTCTTTCCTCCGCCTTTCCTCTGTTTTCCTCTTCCTGTCTCCCCTCCCTCCCACCTTT TTCTTTCCTTCCCAATTCCTTGCACTCTAACCAGTTCTTGGATGCATCTTCTTCCTTCCCTTTCCTC TTGCTGTTTCCTTCCTGTGTTGTTTTGTTGCCCA |
| 3562 | MYADM | 3841094 | TTGCCTGTCGGCTTTCTTATCTGCCTGTTTTGCAAGCACCTTCTCCTGTGTCCTTGGGAGCCCTG AGACTTCTTTCTCTCCTTGCCTCCACCCACCTCCAAAGGTGCTGAGCTCACATCCACACCCCTTG CAGCCGTCCATGCCACAGC |
| 3563 | MYADM | 3841095 | GGAGGAAGGTGTGCAGTGTACTTCCCCTTTAAAT |
| 3564 | MYADM | 3841096 | ATTTGGAGGTCAGTAATTTCCAATGGGCGGGAG |
| 3565 | MYADM | 3841097 | GTCCCTAGGCCCCGCCTGGCACTCAGCCTTGCCAGAGATTGGCTCCAGAATTTTTGCCAGGCT TACAGAACACCCACT |
| 3566 | MYADM | 3841098 | AACTATTCTCTGTGGTATCAAAAAGA |
| 3567 | MYADM | 3841099 | GGCCCTCTGTGTTAAGAATAACGTGTCCTGCTTTGGCAGAGAGAAGAAAATAGCCACTGCCC GCTTTCAAGGCAAGATCGACCTTTTCTGTTTTGTTTTGTTTTCTTTCTTTTTCCTGGCCATGAG GACAAAAATTACTGAGTGGCCCTTAAAGAGGGAAGTTTGTTTTCAGCTGTTCTCTTTTGCCCGT AGGTGGGAGGGTGGGATTGCTGCGTCCTAGCTAGAGGAATGGCTTTGCTTGAATGTGTAGT GCACACGCACGGGTGTTTCTGTGTGCTAGTTGCTTCTTGCTGCTGCTTCCTGCTTGTCTGGGAC TCACATACATAACGTGATATATATATATATATATATAAATGTATAAATATATATTTTATTTTTTTT TAAATCCCTGGAGCTTCTGGTTCCTATCAGTTC |
| 3568 | C3 | 3848041 | CTACATCATCGGGAAGGACACTTGGGTGGAGCACTGGCCCGAGGAGGACGAATGCCAAGAC GAAGAGAACCAGAAACAATGCCAGGACCTCGGCGCCTT |
| 3569 | C3 | 3848042 | TGAGTGCTTTCCCTGCGCGTGCGCGCGACCGCCCGACTGCCCCGCCCATGCCACGCCCACACC ATTGTCACGCCCCTGCGCC |
| 3570 | C3 | 3848043 | AGGTTGGACAGCAGCGCACGTTCATCAGCCCCATCAAGTGCAGAGAAGCCCTGAAGCTGGA GGAGAAGAAACACTACCTCATGTGGGGTCTCTCCTCCGATTTCTGGGGAGAG |
| 3571 | C3 | 3848044 | TTCAGCTGTCCAATGACTTTGACGAGTACATCATGGCCATTGAGCAGACCATCAAGTCAG |
| 3572 | C3 | 3848046 | GTGAGTTCCCTGGAGCCGGGAACAG |
| 3573 | C3 | 3848047 | AAGCTGTACCCGGTTCTACCATCCGGAAAAGGAGGATGGAAAGCTGAACAAGCTCTGCCGTG ATGAACTGTGCCGCTGTGCT |
| 3574 | C3 | 3848048 | TCTGATGGTTCCAGGGGCCTGAGAGTCCCAG |
| 3575 | C3 | 3848049 | CTCACACTCTGAGGATGACTGTCTAGCTTTCAAAGTTCACCAATACTTTAATGTAGAGCTTATC CAGCCTGGAGCAGTCAAGGTCTACGCCTATTACAACCTG |
| 3576 | C3 | 3848052 | TATGTCTATATTGGACATATCCATGATGACTGGCTTTGCTC |
| 3577 | C3 | 3848053 | GCAGGGTCAACATCACCATAGTCTGCTATTCTTTGATAACTCCATTTATGCTGTCTTTGAAGTT CACTTCTGGCATTATCACTTTTCATTTCTTTGCTGCATTTTTATCTTTGTTGGCCAGTTCCCTCTT TTCGTGATACATTGTTGTAAAATCTCATGGGAGTTAGCCACCTGGAGACAGGGAGGCAACAG AACTACACACTTTGCTGTCTGTGCATAAATTGAAGAGCAGAAGCTCAGTGACCAATCACTGAT GGACTTTGAAAGGAGTGACAGTAATTGGCCCTCAATTATGATGCTTATCTTTTATTTATGTCGT GATTTCTAGACTGAAGAGTTAGCAACAAAGTTTATACACATATGCAACTACTCGTGATCAATAT ACCAAGGTACTGAAAAAGAACCATGTCACTGGGCTACTAGTGTTATTTAACTGAATCATGCAG AGTGAGGGCTGCCTGTATTCTTGCCTTGTTTTCTAGAACTGAAGCATGGAGGGTCAAATAATG CATCCAATGTTATTTAGAGCTGGAATTTGAATCCATGCAGTTGGGTGCAGAGTCTGAGCTCTT AATCACCTTGACCATTACATTACCTTGCTTTTTAATTTCCTTTGGGGAAATGTTTCCTAAAAATG TAACGCCCCTCTGTGCTGCTATGTGGGAATCAGAAGTCTCAGTGCCTGATCAGACCTCCTTGTC |
| 3578 | C3 | 3848054 | TAAGAAGCTAGGTCACCGGGGTTCATCTTGGCCATCCCTCTATCTCTAGCAAGAATTCTTGCA AATAATATCCATGATATTCAGTACTTTCCAAGTACACTGTGTATCTGATACTGTT |

TABLE 13-continued

Subtyping Target Sequences

| SEQ ID NO. | Gene | Affy Probeset ID | Sequence |
|---|---|---|---|
| 3579 | C3 | 3848055 | AAAGAGGCCTCAGGATGCCAAGAACACTATGATCCTTGAGATCTGTACCAG |
| 3580 | C3 | 3848057 | CATGCTAAGGCCAAAGATCAACTCACCTGTAATAAATTCGACCTCAAGGTCACCATAAAACCAGCACCGGAAACA |
| 3581 | C3 | 3848059 | AGGAAAAGGCCAAGGCACCTTGTCG |
| 3582 | C3 | 3848061 | ACCTTCATGGTGTTCCAAGCCTTGGCTCAATACCAAAAGGACGCCCCTGACCACCAGGAACTGAACCTTGATGTGTCCCTCCAACTGCCCAGCCGCAGCTCCAAGATCACCCACCGTATCCACTGGGAATCTGCCAGCCTCCTGCGATCAGAAGAG |
| 3583 | C3 | 3848065 | CGTTGGCTCAATGAACAGAGATACTACGGTGGTGGCTATGGC |
| 3584 | C3 | 3848066 | ATAAGAACCGCTGGGAGGACCCTGGTAAGCAGCTCTACAACGTGGAGGCCACATCCTATGCCCTCTTGGCCCTACTGCAGCTAAAA |
| 3585 | C3 | 3848067 | GCCAAGCTGAGATGGATAGTCCTAAGGTATCAAGCTGGGATGCATAACCCTGAGCTGAGCTGGGATGCACGGCTCTAAGTTTTCGCAGGTCCTCATTGTAAACCACACGAGAAAGTTTGTTGCGTCATTTATTCAACAAATGCGTATTAAGCATTCATTTCAAAGGGAGAAGTGAGAGTTGATGAAACAAGAGAGGTAAGGCAGGAGCCAAGTAATTGAGAGCCTCGAATGTCAGCCAGGACACCCAAACACCAGGAAGTCTAGCATGCATCTC |
| 3586 | C3 | 3848068 | CCTTGAAGCCAACTACATGAACCTACAGAGATCCTACACTGTGGCCATTGCTGGCTATGCTCTGGCCCAGATGGGCAGGCTGAAGGGGCCTCTTCTTAACAAATTTCTGACCACAGC |
| 3587 | C3 | 3848074 | CCGCCTACGTGGTCAAGGTCTTCTCTCTGGCTGTCAACCTCATCGCCATCGACTCCCAAGTCCTCTGCGGGGCTGTTAAATGGCTGATCCTGGAGAAGCAGAAGCCCGACGGGGTCTTCCAGGAGGATGCGCCCGTGATACACCAAGAAATG |
| 3588 | C3 | 3848075 | AGCTCTGCCTTTGCGGCCTTCGTGAAACGGGCACCCAGCACCTG |
| 3589 | C3 | 3848076 | CGCGGAACGGCTGAAGCACCTCATTGTGACCCCCTCGGGCTGCGGGGAACAGAACATGATCGGCATGACGCCCACGGTCATCGCTGTGCATTACCTGGATGAAACGGAGCAGTGG |
| 3590 | C3 | 3848077 | TGCAGACCTCAGTGACCAAGTCCCGGACACCGAGTCTGAGACCAGAATTCTCCT |
| 3591 | C3 | 3848078 | ACAAAACTGTGGCTGTTCGCACCCTGGATCCAGAACGC |
| 3592 | C3 | 3848080 | CAAGAGGCGTCACCAGCAGACCGTAACCATCCCCCCCAAGTCCTCGTTGTCCGTTCCATATGTCATCGTGCCGCTAAAGACCGGCCTGCAGGAAGTGGAAGTCAAGGCTGCTGTCTACCATCATTTCATCAGTGACGGTGTC |
| 3593 | C3 | 3848081 | GGGTAGGTAGCCTGTTGCACACACACTTGCCCGGATCCTTTCTCTC |
| 3594 | C3 | 3848082 | GTGGAAATCCGAGCCGTTCTCTACAATTACCGGCAGAACC |
| 3595 | C3 | 3848083 | CTGTGTGGCAGACCCCTTCGAGGTCACAGTAATGCAGGACTTCTTCATCGACCTGCGGCTACCCTACTCTGTTGTTCGAAACGAGC |
| 3596 | C3 | 3848085 | TTGCAGAAGAGAACATCGTTTCCCGAAGTGAGTTCCCAGAGAGCTGGCTGTGGAACGTTGAGGACTTGAAAGAGCCACCGAAAAATGG |
| 3597 | C3 | 3848088 | GACGGCATGCGGGAGAACCCCATGAGGTTCTCGTGCCAGCGCCGGACCCGTTTCATCTCCCTGGGCGAGGCGTGCAAGAAGGTCTTCCT |
| 3598 | C3 | 3848089 | GACGCCGTTCCGTGCAGCTCACGGAGAAGCGAATGGACAAA |
| 3599 | C3 | 3848090 | AGGATTACGCCGGTGTCTTCTCCGACGCAGGGCTGACCTTCACGAGCAGCAGTGGCCAGCAGA |
| 3600 | C3 | 3848092 | CCAGTCAGAAGACCGGCAGCCTGTACCTGGGCAGCAGATGACCCTGAAGATAGAGGGTGACCACGGGGCCCGGTGGTACTGGTGGCCGTGGACAAGGGCGTGTTCGTGCTGAATAAGAAGACAAACTGACGCAGAGTAAG |
| 3601 | C3 | 3848093 | AACAAGGGCAGGCTGTTGAAGGCGGGACGCCAGGTGCGAGAGCCCGGCCAGGACCTGGTGTGCTGCCCCTGTCCATCACCACCGACTTCATCCCCTTCCTTCCGCCTGGTGGCGTACTACACGCTGATCGTGCCAGCGGCCAGAGGGAGGTGGTGGCCGACTCCGTGTGGGTGGACGTCAAGGACTCCT |
| 3602 | C3 | 3848094 | CATCCCGGATCCCTCCCTGCGTTCCCTGCCACTC |
| 3603 | C3 | 3848095 | AGGCTACCAGGACCATGCAGGCTCTGCCCTACAGCACCGTGGGCAACTCCAACAATTACCTGCATCTCTCAGTGCTACGTACAGAGCTCAGACCCGGGGAGACCCTCAACGTCAACTTCCTCCTGCGAATGGACCGCGCCCACGAGGCCAAGAT |

TABLE 13-continued

Subtyping Target Sequences

| SEQ ID NO. | Gene | Affy Probeset ID | Sequence |
|---|---|---|---|
| 3604 | C3 | 3848096 | TGTTCGTGACGAACCCTGATGGCTCTCCAGCCTACCGAGTCCCCGTGGCAGTCCAGGGCGAGGACACTGTGCAGTCTCTAACCCAGGGAGATGGCGTGGCCA |
| 3605 | C3 | 3848097 | CCCATCGTGACCTCTCCCTACCAGATCCACTTCACCAAGACACCCAAGTACTTCAAACCAGGAATGCCCTTTGACCT |
| 3606 | C3 | 3848098 | TTGTGCTGAGCCGGAAGGTACTGCTGGACGGGGTGCAGAACCCCGAGCAGAAGACCTGGTGGGGAAGTCTTTGTACGTGTCTGCCACCGTCATCTTGCACTCA |
| 3607 | C3 | 3848099 | AGAAAGTGGAGGGAACTGCCTTTGTCATCTTCGGGATCCAGGATGGCGAACAGAGGATTTCCCTGCCTGAATCCCTCAAG |
| 3608 | C3 | 3848100 | AGTTTCGAGGTCATAGTGGAGCCTACAGAGAAATTCTACTACATCTATAACGAGAAGGGCCTGGAGGTCACCATCACCGCCAG |
| 3609 | C3 | 3848101 | GGCCAGTGGAAGATCCGAGCCTACTATGAAAACTCACCACAGCAGGTCTTCTCCACT |
| 3610 | C3 | 3848102 | GTCAAGCAGGACTCCTTGTCTTCTCAGAACCAGCTTGGCGTCTTGCCCTTGTCTTGGGACATTCCGGA |
| 3611 | C3 | 3848103 | GTGCCAGCCAGAGGGGCCCCAGGGGAAGCAGGGGCACA |
| 3612 | C3 | 3848105 | CCAACAGGGAGTTCAAGTCAGAAAAGGGGCGCAACAAGTTCGTGACCGTGCAGGCCACCTTCGGGACCCAAGTGGTGGAGAAGGTGGTGCTGGTCAGCCTGCAGAGCGGGTACCTCTTCATCCAG |
| 3613 | C3 | 3848106 | CCCACGACGCGCAAGGGGATGTTCCAGTCACTGTTACTGTCCACGACTTCCCAGGCAAAAAACTAGTGCTGTCCAGTGAGAAGACTGTGC |
| 3614 | C3 | 3848107 | GCTGCTCCTGCTACTAACCCACCTCCC |
| 3615 | C3 | 3848108 | GTCCCTCTGACCCTGCACTGTCCCAGCACC |
| 3616 | C3 | 3848109 | TGCGCCTGGCAAGGGGATGCAGTTTCA |
| 3617 | C3 | 3848112 | GTCCGTGGATTCTGCTTTCAGTTAAACCCTGATCACTTCACCTCCCTGAGCCTCAGTTACCTTATCTGAATATCGGGATCATGACGGATAATTGTATGTCATCTATTCTACCGACGGCAGCCAGAGGACGCCTGTGAGCACCTGAGTCAGGGCCCATCCCTGCTCTGCCTACAGCCCTCCATGGCTCCCACCTTCCTATGCGTCAAAGCCCAAGTCCTCCCTGCAGTCCACAAGGCCCTGCACACCTTGCCCTGTCCCTTCCCTGCCCTCCCCTCCTCCCTCTCTCCCCCTCGTTCACTCTTTCTGGAGCCACACGGGCCATCCTCCCTGTTCCTCCAACACCCAGGTGCAGTCCTGCCTTGGCGCCTTGGCACGGGCTGTGCCCTCTTCTCAAGAAAACCCTCTTCTTCCAAATATCCACACAGCTTGTTCTCTCTCCTCCTTTAAGTCTTTGCTCAAATGTCACCAATGTCTCAATTTTACAATGAGGTCTCTCTGAGTAACCTATAAAGTCGCAAATACCCACCCTGAGCGTCCCCCCTCCCCGCTACACACTCCTCCTTCCTGCCATGTCCTGCAAATGAGATTTATTCATTTGATAATTGCTTCTCCCATCGCCTCGCCCTCTATTGAACCTAAATCCCTCCAGGAAGGAATTGTTATGTTTGTTGAGGGTTTTGTCACCTGAACTCAGC |
| 3618 | C3 | 3848119 | CTCCCTTCCAGCTATGTGTACAATAATGACCAATCTGTTTGGCTACGCCGTTGTCTTGCCTTTTTGGGGGTTGGGGTCTACACGGAGGTTGTGTTTACAATGTAGAAACCTGTTTTCGCTGTGTGTGGCGGGGGCGCGGGCACAGGGTCCGTGTCTTTGTATA |
| 3619 | C3 | 3848120 | ATCTCAGACCAAAGGGTCGTCCTCCCCCAGCATT |
| 3620 | C3 | 3848121 | ACAAAACAGCCAGCGGGCGGGAACTGTTATGA |
| 3621 | MUC16 | 3849299 | GTGCCTTTCCCCCAGCCAGGGTCCAAAGAAGCTTGGCTGGGGCAGAAATAAACCATAT |
| 3622 | MUC16 | 3849300 | TGACCACCCGCCGGCGGAAGAAGGAAGGAGAATACAACGTCCAGCAACAGTGCCCAGGCTACTACCAGTCACACCTAGACCTGGAGGATCTGC |
| 3623 | MUC16 | 3849301 | GGCTGTCATCCTCATCGGCTTGGCAGGACTCCTGGGAGTCATCACATGCCTGATCTGCGGTGTCCTG |
| 3624 | MUC16 | 3849302 | CCCAACAGAAATGAGCCCTTAACTGGGA |
| 3625 | MUC16 | 3849304 | GGTGGACTCCCTGTGTAACTTCTCGCCACTGGCTCGGAGAGTAGACAGAGTTGCCATCTATGAGGAATTTCTGCGGATGACCCGGAATGGTACCCAGCTGCAGAACTTC |
| 3626 | MUC16 | 3849306 | TTCTACCTGAATTTCACCATCACCAACCTACCATATTCCCAGGACAAAGCCCAGCCAGGCACCACCAATTACCAGAGGA |
| 3627 | MUC16 | 3849307 | ATGGAGTCATCAGTTTATCAACCAACAAGCAGCTCCA |

TABLE 13-continued

Subtyping Target Sequences

| SEQ ID NO. | Gene | Affy Probeset ID | Sequence |
|---|---|---|---|
| 3628 | MUC16 | 3849309 | CGTGTTGGTCACTGTCAAGGCATTGTTCTCCTCCAATTTGGACCCCAGCCTGGTGGAGCAAGTCTTTCTAGATAAGACCCTGAATGCCTCATTCCATTGGCTGGGCTCCACCTACCAGTTGGT |
| 3629 | MUC16 | 3849311 | AGGCAGTCAACTACATGACACATTCCGCTTCTGCCT |
| 3630 | MUC16 | 3849312 | CCCAGAATTTATCAATCCGGGGCGAGTACCAGATAAATTTCCACATTGTCAACTGGAACCTCAGTAATCCAGACCC |
| 3631 | MUC16 | 3849313 | CTATGTCCTGGACAGGGATAGCCTCTTCATCAA |
| 3632 | MUC16 | 3849315 | CAGCATGGGCCCCTTCTACTTGGGTTGCCAACTGATCTCCCTCA |
| 3633 | MUC16 | 3849316 | CATGGGGTACCACCTGAAGACCCTCACACTCAACTTCACCATCTCCAATCTCCAGTATTCACCAGATATGGGCAAGGGCTCAGCTACATTCAACTCCACCGAGGG |
| 3634 | MUC16 | 3849317 | GCCTCCTCTGTCAGAAGCCACAACAG |
| 3635 | MUC16 | 3849319 | AGACACGGGTGGACCTCCTCTGCACCTACCTGCAGCCCCTCAGCGGCCCAGGTCTGCCTATCAAGCAGGTGTTCCATGAGCTGAGCCAGCAGACCCATGGCATCACCCGGCTGGGCCCCTACTCTCTGGACAAAGACAGCCTCTACCTT |
| 3636 | MUC16 | 3849320 | GAGCAGCCTGGGTGCACGGTACACAGGCTGCAGGGTCATCGCACTAAG |
| 3637 | MUC16 | 3849321 | TCACACTGAACTTCACCATCAACAACCTGCGCTACATGGCGGACATGGGCCAACCCGGCTCCCTCAAGTTCAACATCACAG |
| 3638 | MUC16 | 3849324 | AGCTGACCCACAGCATCACTGAGCTGGGCCCCTACACACTGGACAGGGACAGTCTCTATGTCAATG |
| 3639 | MUC16 | 3849326 | GCCCTTGTTCAAGAACACCAGTGTTGGCCCTCTGTACTCTGGCTGCAG |
| 3640 | MUC16 | 3849327 | AACATGTGGCCTGGCTCCAGGAAGTTCAA |
| 3641 | MUC16 | 3849328 | TGGGAGCATCTAAGACTCCAGCCTCGATATTTGGCCCTTCAG |
| 3642 | MUC16 | 3849329 | ACTCATCGGAGCTCTGTGTCCACCACCAGC |
| 3643 | MUC16 | 3849330 | TATGCCCTGGACAACGACAGCCTCTTTGTCA |
| 3644 | MUC16 | 3849331 | TGTTCAAGAGCACCAGTGTTGGCCCTCTGTACTCTGGCTGCAGACT |
| 3645 | MUC16 | 3849332 | TCACCAACCTGCGGTATGAGGAGAACATG |
| 3646 | MUC16 | 3849333 | ACATCTGGGACTCCAGTTTCTAAACC |
| 3647 | MUC16 | 3849336 | AGCTGACCCACAGCATCACTGAGCTGGGCCCCTACACCCTGGACAGGGACAGTCTCTATGTCAATG |
| 3648 | MUC16 | 3849338 | TGTTCAAGAACACCAGTGTTGGCCCTCTGTACTCTGGCTGCAGACT |
| 3649 | MUC16 | 3849340 | CCTGGTGCTATTCACAATTAACTTCACCATCACTAACCTGCGGTATGAGGAGAACATGCATCACCCTGGCTCTAGAAAGTTTAACACCACGGAGAGA |
| 3650 | MUC16 | 3849341 | TGGCAACCTCGAGAACTCCAGCCTCCCTGT |
| 3651 | MUC16 | 3849342 | ACCCATCAGAGCTCTATGACGACCACCAGAA |
| 3652 | MUC16 | 3849343 | AGTGGATGCTGTCTGCACCCATCGTCCTGA |
| 3653 | MUC16 | 3849345 | TGCCCTTGTTCAAGAACACCAGTGTCAGCTCTCTGTACTC |
| 3654 | MUC16 | 3849347 | TTTTACCATCACTAACCTGCAGTAT |
| 3655 | MUC16 | 3849348 | CTTTCACAGTACAGCCGGAAACCTCTGAGACTCCATCATCC |
| 3656 | MUC16 | 3849350 | ATGGAGTAGCCACCAGAGTGGACGCCATCTG |
| 3657 | MUC16 | 3849351 | TGTTCAAGAGCACCAGTGTTGGCCCTCT |
| 3658 | MUC16 | 3849353 | TCCTTGGACTTCCACAGTTGACCTT |
| 3659 | MUC16 | 3849355 | CACCACCTTAACCCTCAAAGCCCTGGACTGGACA |
| 3660 | MUC16 | 3849357 | GGCCCTCTGTACTCTGGCTGCAGACT |

TABLE 13-continued

Subtyping Target Sequences

| SEQ ID NO. | Gene | Affy Probeset ID | Sequence |
|---|---|---|---|
| 3661 | MUC16 | 3849359 | TCTCCTGGTGCCGTTCACCCTCAACTTTACCATCACCAATCTGCAGTATGGGGAGGACATGCG<br>TCACCCTGGCTCCAGGAAGTTCAACACCAC |
| 3662 | MUC16 | 3849360 | GGGACCTCCACAGTGGACCTTGGGACCTCAGGG |
| 3663 | MUC16 | 3849362 | TGACCCATGGCATCAAAGAGCTGGG |
| 3664 | MUC16 | 3849363 | GGCCTTCTGTACTCTGGCTGCAGACT |
| 3665 | MUC16 | 3849365 | ATCACCAACCTGCAGTACGAGGAGGACATGCATCACCCAGGCTCCAGGAAGTTCAACACCAC<br>GGAG |
| 3666 | MUC16 | 3849366 | GGGACCTCCACAGTGGACCTTGGGACCTCAGGG |
| 3667 | MUC16 | 3849367 | CCCATCAGACCTCTGCGCCCAACACCAGCA |
| 3668 | MUC16 | 3849368 | TGGAGTGGATGCCATCTGCACCCACCGTCTTGACCCCAAAAGCCCTGGAGTGGACAGGGAGC<br>AGCTATACTGGGAGCTGAGCCAGCTGACCAATGGCATCA |
| 3669 | MUC16 | 3849370 | TGTTCAAGAACACCAGTGTTGGCCCTCTGTACTCTGGCTGCAGACT |
| 3670 | MUC16 | 3849372 | TCTCCTGGTGCCGTTCACCCTCAACTTCACCATCACCAACCTGAAGTACGAGGAGGACATGCA<br>TTGCCCTGGCTCCAGGAAGTTCAACACCAC |
| 3671 | MUC16 | 3849373 | TCCACAGTGGACCTTGGGTCAGGGACTCCATCCTCCCTCC |
| 3672 | MUC16 | 3849375 | TGGAGTGGATGCCATCTGCACCCACCGTCTTGACCCCAAAAGCCCTGGAGTGGACAGGGAGC<br>AGCTATACTGGGAGCTGAGCCAGCTGACCAATGGCATCAAAGAGCTGGGCCCCTACACCCTG<br>GACAGGAACAGTCTCTATG |
| 3673 | MUC16 | 3849377 | GGCCTTCTGTACTCTGGCTGCAGACT |
| 3674 | MUC16 | 3849379 | CCTGGCTCCAGGAAGTTCAACACCAC |
| 3675 | MUC16 | 3849380 | GGGACCTCCACAGTGGACCTTGGAACCTCAGGGACTCCATTCTCCCTCCCAAGCCCCGCA |
| 3676 | MUC16 | 3849381 | TTTCACCCATCGGACCTCTGTGCCCACCAGCA |
| 3677 | MUC16 | 3849382 | GGCATCAAAGAGCTGGGCCCCTACACCCTGGACAGGAACAGTCTCTATGTCAATG |
| 3678 | MUC16 | 3849383 | TGTTGGCCCTCTGTACTCTGGCTGCAGACT |
| 3679 | MUC16 | 3849384 | CCTGGCTCCAGGAAGTTCAACACCAC |
| 3680 | MUC16 | 3849385 | CCTCCACAGTGGATCTCAGAACCTCAGGGACTCCATCCTCCC |
| 3681 | MUC16 | 3849388 | TAAGCAAACTGACCAATGACATTGAAG |
| 3682 | MUC16 | 3849389 | GCCCTTGTTCAAGAACACCAGTGTTGGCCCTCTGTACTCTGGCTGCAGA |
| 3683 | MUC16 | 3849390 | ATCACCAACCTGCAGTACGAGGAGGACAT |
| 3684 | MUC16 | 3849391 | CCTGGGACCTCCACAGTGGATGTGGGAACCTCAGGGACTCCATCCTCCAG |
| 3685 | MUC16 | 3849393 | TTTCACCCATCGAAGCTCTATGCCCACCACCA |
| 3686 | MUC16 | 3849394 | GAAGGATAGCTCAGCCACGGCAGTGGATGCCATCTGCACACATCGCCCTGACCCTGAAGACC<br>TCGGACTGGACAGAGAGCGACTGTACTGGGAGCTGAGCAATCTGACAAATGGCATCAGGA |
| 3687 | MUC16 | 3849396 | CCTTGTTCAGGAATAGCAGTCTGGAATACCTCTATTCAGGCTGCAGACTAGCCTCACTC |
| 3688 | MUC16 | 3849397 | ATCACCAACCTGCAGTACGAGGAGGACAT |
| 3689 | MUC16 | 3849398 | GGATTTCCACATCCTCCATCCCCAGCTCCACAG |
| 3690 | MUC16 | 3849400 | CGTCGGTACTGGACCCCTGCCACCAGCA |
| 3691 | MUC16 | 3849403 | TCGCCTGCTGTATCACGGTTGGTGACCTCAATGGTCACCAGTTTGGCGGCAAAGACAAGTACA<br>ACTAATCGAGCTCTGACAAAACTCCCCTGGTGAACCAGCTACAACAGTTTCATTGGTCACGCAT<br>CCTGCACAGACCAGCCCAACAGTTCCCTGGACAACTTCCATTTTTTTCCATAGTAAATCAGACA<br>CCACACCTTCAATGACCACCAGTCATGGGCAGAATCCAGTTCAGCTGTTCCAACTCCAACTG<br>TTTCAACTGAGGTACCAGGAGTAGTGACCCCTTTGGTCACCAGTTCTAGGGCAGTGATCAGTA<br>CAACTATTCCAATTCTGACTCTTTCTCCTGGTGAACCAGAGACCACACCTTCAATGGCCACCAG |

TABLE 13-continued

Subtyping Target Sequences

| SEQ ID NO. | Gene | Affy Probeset ID | Sequence |
|---|---|---|---|
| | | | TCATGGGAAGAAGCCAGTTCTGCTATTCCAACTCCAACTGTTTCACCTGGGGTACCAGGAGT<br>GGTGACCTCTCTGGTCACTAGTTCTAGGGCAGTGACTAGTACAACTATTCCAATTCTGACTTTT<br>TCTCTTGGTGAACCAGAGACCACACCTTCAATGGCCACCAGTCATGGGACAGAAGCTGGCTC<br>AGCTGTTCCAACTGTTTTACCTGAGGTACCAGGAATGGTGACCTCTCTGGTTGCTAGTTCTAG<br>GGCAGTAACCAGTACAACTCTTCCAACTCTGACTCTTTCTCCTGGTGAACCAGAGACCACACCT<br>TCAATGGCCACCAGTCATGGGGCAGAAGCCAGCTCAACTGTTCCAACTGTTTCACCTGAGGTA<br>CCAGGAGTGGTGACCTCTCTGGTCACTAGTTCTAGTGGAGTAAACAGTACAAGTATTCCAACT<br>CTGATTCTTTCTCCTGGTGAACTAGAAACCACACCTTCAATGGCCACCAGTCATGGGGCAGAA<br>GCCAGCTCAGCTGTTCCAACTCCAACTGTTTCACCTGGGGTATCAGGAGTGGTGACCCCTCTG<br>GTCACTAGTTCCAGGGCAGTGACCAGTACAACTATTCCAATTCTAACTCTTTCTTCTAGTGAGC<br>CAGAGACCACACCTTCAATGGCCACCAGTCATGGGGTAGAAGCCAGCTCAGCTGTTCTAACT<br>GTTTCACCTGAGGTACCAGGAATGGTGACCTCTCTGGTCACTAGTTCTAGAGCAGTAACCAGT<br>ACAACTATTCCAACTCTGACTATTTCTTCTGATGAACCAGAGACCACAACTTCATTGGTCACCC<br>ATTCTGAGGCAAAGATGATTTCAGCCATTCCAACTTTAGCTGTCTCCCCTACTGTACAAGGGCT<br>GGTGACTTCACTGGTCACTAGTTCTGGGTCAGAGACCAGTGCGTTTTCAAATCTAACTGTTGC<br>CTCAAGTCAACCAGAGACCATAGACTCATGGGTCGCTCATCCTGGGACAGAAGCAAGTTCTG<br>TTGTTCCAACTTTGACTGTCTCCACTGGTGAGCCGTTTACAAATATCTCATTGGTCACCCATCCT<br>GCAGAGAGTAGCTCAACTCTTCCCAGGACAACCTCAAGGTTTTCCCACAGTGAATTAGACACT<br>ATGCCTTCTACAGTCACCAGTCCTGAGGCAGAATCCAGCTCAGCCATTTCAACAACTATTTCAC<br>CTGGTATACCAGGTGTGCTGACATCACTGGTCACTAGCTCTGGGAGAGACATCAGTGCAACTT<br>TTCCAACAGTGCCTGAGTCCCCACATGAATCAGAGGCAACAGCCTCATGGGTTACTCATCCTG<br>CAGTCACCAGCACAACAGTTCCCAGGACAACCCCTAATTATTCTCATAGTGAACCAGACACCA<br>CACCATCAATAGCCACCAGTCCTGGGGCAGAAACCACTTCAGATTTTCCAACAATAACTGTCT<br>CACCTGATGTACCAGATATGGTAACCTCACAGGTCACTAGTTCTGGGACAGACACCAGTATAA<br>CTATTCCAACTCTGACTCTTTCTTCTGGTGAGCCAGAGACCACAACCTCATTTATCACCTATTCT<br>GAGACACACACAAGTTCAGCCATTCCAACTCTCCCTGTCTCCCCTGGTGCATCAAAGATGCTG<br>ACCTCACTGGTCATCAGTTCTGGGACAGACAGCACTACAACTTTCCCAACACTGACGGAGACC<br>CCATATGAACCAGAGACAACAGCCATACAGCTCATTCATCCTGCAGAGACCAACACAATGGTT<br>CCCAGGACAACTCCCAAGTTTTCCCATAGTAAGTCAGACACCACACTCCCAGTAGCCATCACC<br>AGTCCTGGGCCAGAAGCCAGTTCAGCTGTTTCAACGACAACTATCTCACCTGATATGTCAGAT<br>CTGGTGACCTCACTGGTCCCTAGTTCTGGGACAGACACCAGTACAACCTTCCCAACATTGAGT<br>GAGACCCCATATGAACCAGAGACTACAGCCACGTGGCTCACTCATCCTGCAGAAACCAGCAC<br>AACGGTTTCTGGGACAATTCCCAACTTTTCCCATAGGGGATCAGACACTGCACCCTCAATGGT<br>CACCAGTCCTGGAGTAGACACGAGGTCAGGTGTTCCAACTACAACCATCCCACCCAGTATACC<br>AGGGGTAGTGACCTCACAGGTCACTAGTTCTGCAACAGACACTAGTACAGCTATTCCAACTTT<br>GACTCCTTCTCCTGGTGAACCAGAGACCACAGCCTCATCAGCTACCCATCCTGGGACACAGAC<br>TGGCTTCACTGTTCCAATTCGGACTGTTCCCTCTAGTGAGCCAGATACAATGGCTTCCTGGGTC<br>ACTCATCCTCCACAGACCAGCACACCTGTTTCCAGAACAACCTCCAGTTTTTCCCATAGTAGTC<br>CAGATGCCACACCTGTAATGGCCACCAGTCCTAGGACAGAAGCCAGTTCAGCTGTACTGACA<br>ACAATCTCACCTGGTGCACCAGAGATGGTGACTTCACAGATCACTAGTTCTGGGGCAGCAACC<br>AGTACAACTGTTCCAACTTTGACTCATTCTCCTGGTATGCCAGAGACCACAGCCTTATTGAGCA<br>CCCATCCCAGAACAGAGA |
| 3692 | MUC16 | 3849404 | AAAATACCCAATGAAGCAGCACACAGAGGTACCATAAGACCAGTCAAAGGCCCTCAGACATC<br>CACTTCGCCTGCCAGT |
| 3693 | MUC16 | 3849406 | GCAGCACTACTGAAGGACGCTTGGTTATGGTCAGTACTTTGGACACTTCAAGCCAACCAGGC<br>AGGACATCTTCATCACCCATTTTGGATACCAGAATGACAGAGAGCGTTGAGCTGGGAACAGT<br>GACAAGTGCTTATCAAGTTCCTTCACTCTCAACACGGTTGA |
| 3694 | MUC16 | 3849408 | CCTGGGGATGCTACTCTGTCCACCATTGCAGAGAGCCTGCCTTCATCCACTCCTGTGCCATTCT<br>CCTCTTCAACCTT |
| 3695 | MUC16 | 3849410 | TCATTTGCCACCACTGGAGTTCCACGAGCCATCTCAGGTTCAG |
| 3696 | MUC16 | 3849412 | TCCAAGGCTACATACCCAGTGGGTACTCCCTCTTCCATGGCTGAAACCTCTATTTCCACATCAA<br>TGCCTGCTAATTTTGAGACCACAGGATTTGAGGCTGAGCCATTTTCTCATTTGACTTCTGGATT<br>TAGGAAGACAAACATGTCCCTGGACACCAGCTCAGTCACACCAACAAATACACCTTCTTCTCCT<br>GGGTCCACTCACCTTTTACAGAGTTCCAAGACTGATTTCACCTCTTCTGCAAAAACATCATCCC<br>CAGACTGGCCTCCAGCCTCACAGTATACTGAAATTCCAGTGGACATAATCACCCCCTTTAATGC<br>TTCTCCATCTATTACGGAGTCCACTGGGATAACCTCCTTCCCAGAATCCAGGTTTACTATGTC |
| 3697 | MUC16 | 3849414 | TGGCCCGGCGACAACCACAGATATCTTGGGTACAAGCACAGAACCTGGAACCAGTTCATCTTC<br>AAGTTTGAGCACCACCTCCCATGAGAGACTGACCACTTACAAAGACACTGCACATACAGAAGC<br>CGTGCATCCTTCCACAAACACAGGAGGGACCAATGTGGCAACCACCAGCTCTGGATATAAATC<br>ACAGTCCTCTGTCCTAGCTGACTCATCTCCAATGTGTACCACCTCCACCATGGGGGATACAAGT<br>GTTCTCACATCAACTCCTGCCTTCCTTGAGACTAGGAGGATTCAGACAGAGCTAGCTTCCTCCC<br>TGACCCCTGGATTGAGGGAGTCCAGCGGCTCTGAAGGGACCAGCTCAGGCACCAAGATGAG<br>CACTGTCCTCTCTAAAGTGCCCACTGGTGCTACTACTGAGATTCCAAGGAAGACGTCACCTG<br>CATCCCAGGTCCCGCTCAATCCACAATATCACCAGACATCTCCACAAGAACCGTCAGCTGGTTC<br>TCTACATCCCTGTCATGACAGAATCAGCAGAATAACCATGAACACCCATACAAGTCCTTTA<br>GGGGCCACAACACAAGGCACCAGTACTTTGGACACGTCAAGCACAACCTCTTTGACAATGAC<br>ACACTCAACTATATCTCAAGGATTTTCACACTCACAGATGAGCACTCTTATGAGGAGGGTCC<br>TGAGGATGTATCATGGATGAGCCCTCCCCTTCTGGAAAAAACTAGACCTTCCTTTTCTCTGATG |

TABLE 13-continued

Subtyping Target Sequences

| SEQ ID NO. | Gene | Affy Probeset ID | Sequence |
|---|---|---|---|
| | | | TCTTCACCAGCCACAACTTCACCTTCTCCTGTTTCCTCCACATTACCAGAGAGCATCTCTTCCTC
TCCTCTTCCTGTGACTTCACTCCTCACGTCTGGCTTGGCAAAAACTACAGATATGTTGCACAAA
AGCTCAGAACCTGTAACCAACTCACCTGCAAATTTGAGCAGCACCTCAGTTGAAATACTGGCC
ACCTCTGAAGTCACCACAGATACAGAGAAAACTCATCCTTCTTCAAACAGAACAGTGACCGAT
GTGGGGACCTCCAGTTCTGGACATGAATCCACTTCCTTTGTCCTAGCTGACTCACAGACATCCA
AAGTCACATCTCCAATGGTTATTACCTCCACCATGGAGGATACGAGTGTCTCCACATCAACTCC
TGGCTTTTTTGAGACTAGCAGAATTCAGACAGAACCAACATCCTCCCTGACCCTTGGACTGAG
AAAGACCAGCAGCTCTGAGGGGACCAGCTTAGCCACAGAGATGAGCACTGTCCTTTCTGGAG
TGCCCACTGGTGCCACTGCTGAAGTCTCCAGGACAGAAGTCACCTCCTCTAGCAGAACATCCA
TCTCAGGCTTTGCTCAGCTCACAGTGTCACCAGAGACTTCCACAGAAACCATCACCAGACTCC
CTACCTCCAGCATAATGACAGAATCAGCAGAAATGATGATCAAGACACAAACAGATCCTCCTG
GGTCTACACCAGAGAGTACTCATACTGTGGACATATCAACAACACCCAACTGGGTAGAAACCC
ACTCGACTGTGACTCAGAGATTTTCACACTCAGAGATGACCACTCTTGTGAGCAGAAGCCCTG
GTGATATGTTATGGCCTAGTCAATCCTCTGTGGAAGAAACCAGCTCTGCCTCTTCCCTGCTGTC
TCTGCCTGCCACGACCTCACCTTCTCCTGTTTCCTCTACATTAGTAGAGGATTTCCCTTCCGCTT
CTCTTCCTGTGACTTCTCTTCTCAACCCTGGCCTGGTGATAACCACAGACAGGATGGGCATAA
GCAGAGAACCTGGAACCAGTTCCACTTCAAATTTGAGCAGCACCTCCCATGAGAGACTGACCA
CTTTGGAAGACACTGTAGATACAGAAGACATGCAGCCTTCCACACACACAGCAGTGACCAAC
GTGAGGACCTCCATTTCTGGACATGAATCACAATCTTCTGTCCTATCTGACTCAGAGACACCCA
AAGCCACATCTCCAATGGGTACCACCTACACCATGGGGGAAACGAGTGTTTCCATATCCACTT
CTGACTTCTTTGAGACCAGCAGAATTCAGATAGAACCAACATCCTCCCTGACTTCTGGATTGA
GGGAGACCAGCAGCTCTGAGAGGATCAGCTCAGCCACAGAGGGAAGCACTGTCCTTTCTGAA
GTGCCCAGTGGTGCTACCACTGAGGTCTCCAGGACAGAAGTGATATCCTCTAGGGGAACATC
CATGTCAGGGCCTGATCAGTTCACCATATCACCAGACATCTCTACTGAAGCGATCACCAGGCT
TTCTACTTCCCCCATTATGACAGAATCAGCAGAAAGTGCCATCACTATTGAGACAGGTTCTCCT
GGGGCTACATCAGAGGGTACCCTCACCTTGGACACCTCAACAACAACCTTTTGGTCAGGGACC
CACTCAACTGCATCTCCAGGATTTTCACACTCAGAGATGACCACTCTTATGAGTAGAACTCCTG
GAGATGTGCCATGGCCGAGCCTTCCCTCTGTGGAAGAAGCCAGCTCTGTCTCTTCCTCACTGT
CTTCACCTGCCATGACCTCAACTTCTTTTTTCTCCACATTACCAGAGAGCATCTCCTCCTCTCCTC
ATCCTGTGACTGCACTTCTCACCCTTGGCCCAGTGAAGACCACAGACATGTTGCGCACAAGCT
CAGAACCTGAAACCAGTTCACCTCCAAATTTGAGCAGCACCTCAGCTGAAATATTAGCCACGT
CTGAAGTCACCAAAGATAGAGAGAAAATTCATCCCTCCTCAAACACACCTGTAGTCAATGTAG
GGACTGTGATTTATAAACATCTATCCCCTTCCTCTGTTTTGGCTGACTTAGTGACAACAAAACC
CACATCTCCAATGGCTACCACCTCCACTCTGGGGAATACAAGTGTTTCCACATCAACTCCTGCC
TTCCCAGAAACTATGATGACACAGCCAACTTCCTCCCTGACTTCTGGATTAAGGGAGATCAGT
ACCTCTCAAGAGACCAGCTCAGCAACAGAGAAGTGCTTCTCTTTCTGGAATGCCCACTGGT
GCTACTACTAAGGTCTCCAGAACAGAAGCCCTCTCCTTAGGCAGAACATCCACCCCAGGTCCT
GCTCAATCCACAATATCACCAGAAATCTCCACGGAAACCATCACTAGAATTTCTACTCCCCTCA
CCACGACAGGATCAGCAGAAATGACCATCACCCCCAAAACAGGTCATTCTGGGGCATCCTCAC
AAGGTACCTTTACCTTGGACACATCAAGCAGAGCCTCCTGGCCAGGAACTCACTCAGCTGCAA
CTCACAGATCTCCACACTCAGGGATGACCACTCCTATGAGCAGAGGTCCTGAGGATGTGTCAT
GGCCAAGCCGCCCATCAGTGGAAAAAACTAGCCCTCCATCTTCCCTGGTGTCTTTATCTGCAG
TAACCTCACCTTCGCCACTTTATTCCACACCATCTGAGAGTAGCCACTCATCTCCTCTCCGGGT
GACTTCTCTTTTCACCCCTGTCATGATGAAGACCACAGACATGTTGGACACAAGCTTGGAACC
TGTGACCACTTCACCTCCCAGTATGAATATCACCTCAGATGAGAGTCTGGCCACTTCTAAAGCC
ACCATGGAGACAGAGGCAATTCAGCTTTCAGAAAACACAGCTGTGACTCAGATGGGCACCAT
CAGCGCTAGACAAGAATTCTATTCCTCTTATCCAGGCCTCCCAGAGCCATCCAAAGTGACATCT
CCAGTGGTCACCTCTTCCACCATAAAAGACATTGTTTCTACAACCATACCTGCTTCCTCTGAGA
TAACAAGAATTGAGATGGAGTCAACATCCACCCTGACCCCCACACCAAGGGAGACCAGCACC
TCCCAGGAGATCCACTCAGCCACAAAGCCAAGCACTGTTCCTTACAAGGCACTCACTAGTGCC
ACGATTGAGGACTCCATGACACAAGTCATGTCCTCTAGCAGAGGACCTAGCCCTGATCAGTCC
ACAATGTCACAAGACATATCCACTGAAGTGATCACCAGGCTCTCTACCTCCCCCATCAAGACA
GAATCTACAGAAATGACCATTACCACCCAAACAGGTTCTCCTGGGGCTACATCAAGGGGTACC
CTTACCTTGGACACTTCAACACTTTTATGTCAGGGACCCACTCAACTGCATCTCAAGGATTTT
CACACTCACAGATGACCGCTCTTATGAGTAGAACTCCTGGAGATGTGCCATGGCTAAGCCATC
CCTCTGTGGAAGAAGCCAGCTCTGCCTCTTTCTCACTGTCTTCACCTGTCATGACCTCATCTTCT
CCCGTTTCTTCCACATTACCAGACAGCATCCACTCTTCTTCGCTTCCTCTGTGACATCACTTCTCAC
CTCAGGGCTGGTGAAGACCACAGAGCTGTTGGGCACAAGCTCAGAACCTGAAACCAGTTCAC
CCCCAAATTTGAGCAGCACCTCAGCTGAAATACTGGCCATCACTGAAGTCACTACAGATACAG
AGAAACTGGAGATGACCAATGTGGTAACCTCAGGTTATACACATGAATCTCCTTCCTCTGTCC
TAGCTGACTCAGTGACAACAAAGGCCACATCTTCAATGGGTATCACCTACCCCACAGGAGATA
CAAATGTTCTCACATCAACCCCTGCCTTCTCTGACACCAGTAGGATTCAAACAAAGTCAAAGCT
CTCACTGACTCCTGGGTTGATGGAGACCAGCATCTCTGAAGAGACCAGCTCTGCCACAGAAA
AAAGCACTGTCCTTTCTAGTGTGCCCACTGGTGCTACTACTGAGGTCTCCAGGACAGAAGCCA
TCTCTTCTAGCAGAACATCCATCCAGGCCCTGCTCAATCCACAATGTCATCAGACACCTCCAT
GGAAACCATCACTAGAATTTCTACCCCCTCACAAGGAAAGAATCAACAGACATGGCCCATCAC
CCCCAAAACAGGTCCTTCTGGGGCTACCTCGCAGGGTACCTTTACCTTGGACTCATCAAGCAC
AGCCTCCTGGCCAGGAACTCACTCAGCTACAACTCAGAGATTTCCACAGTCAGTGGTGACAAC
TCCTATGAGCAGAGGTCCTGAGGATGTGCATGGCCAAGCCGCTGTCTGTGGAAAAAAACA
GCCCTCCATCTTCCCTGGTATCTTCATCTTCAGTAACCTCACCTTCGCCACTTTATTCCACACCAT
CTGGGAGTAGCCACTCCTCTCCTGTCCCTGTCACTTCTCTTTTCACCTCTATCATGATGAAGGCC
ACAGACATGTTGGATGCAAGTTTGGAACCTGAGACCACTTCAGCTCCCAATATGAATATCACC
TCAGATGAGAGTCTGGCCGCTTCTAAAGCCACCACGGAGACAGAGGCAATTCACGTTTTTGA
AAATACAGCAGCGTCCCATGTGGAAACCACCAGTGCTACAGAGGAACTCTATTCCTCTTCCCC |

TABLE 13-continued

Subtyping Target Sequences

| SEQ ID NO. | Gene | Affy Probeset ID | Sequence |
|---|---|---|---|
| | | | AGGCTTCTCAGAGCCAACAAAAGTGATATCTCCAGTGGTCACCTCTTCCTCTATAAGAGACAA
CATGGTTTCCACAACAATGCCTGGCTCCTCTGGCATTACAAGGATTGAGATAGAGTCAATGTC
ATCTCTGACCCCTGGACTGAGGGAGACCAGAACCTCCCAGGACATCACCTCATCCACAGAGAC
AAGCACTGTCCTTTACAAGATGCCCTCTGGTGCCACTCCTGAGGTCTCCAGGACAGAAGTTAT
GCCCTCTAGCAGAACATCCATTCCTGGCCCTGCTCAGTCCACAATGTCACTAGACATCTCCGAT
GAAGTTGTCACCAGGCTGTCTACCTCTCCCATCATGACAGAATCTGCAGAAATAACCATCACC
ACCCAAACAGGTTATTCTCTGGCTACATCCCAGGTTACCCTTCCCTTGGGCACCTCAATGACCT
TTTTGTCAGGGACCCACTCAACTATGTCTCAAGGACTTTCACACTCAGAGATGACCAATCTTAT
GAGCAGGGGTCCTGAAAGTCTGTCATGGACGAGCCCTCGCTTTGTGGAAACAACTAGATCTT
CCTCTTCTCTGACATCATTACCTCTCACGACCTCACTTTCTCCTGTGTCCTCCACATTACTAGACA
GTAGCCCCTCCTCTCCTCTTCCTGTGACTTCACTTATCCTCTCCCAGGCCTGGTGAAGACTACAGA
AGTGTTGGATACAAGCTCAGAGCCTAAAACCAGTTCATCTCCCAAATTTGAGCAGCACCTCAGT
TGAAATACCGGCCACCTCTGAAATCATGACAGATACAGAGAAAATTCATCCTTCCTCAAACAC
AGCGGTGGCCAAAGTGAGGACCTCCAGTTCTGTTCATGAATCTCATTCCTCTGTCCTAGCTGA
CTCAGAAACAACCATAACCATACCTTCAATGGGTATCACCTCCGCTGTGGACGATACCACTGT
TTTCACATCAAATCCTGCCTTCTCTGAGACTAGGAGGATTCCGACAGAGCCAACATTCTCATTG
ACTCCTGGATTCAGGGAGACTAGCACCTCTGAAGAGACCACCTCAATCACAGAAACAAGTGC
AGTCCTTTATGGAGTGCCCACTAGTGCTACTACTGAAGTCTCCATGACAGAAATCATGTCCTCT
AATAGAATACACATCCCTGACTCTGATCAGTCCACGATGTCTCCAGACATCATCACTGAAGTG
ATCACCAGGCTCTCTTCCTCATCCATGATGTCAGAATCAACACAAATGACCATCACCACCCAAA
AAAGTTCTCCTGGGGCTACAGCACAGAGTACTCTTA |
| 3698 | MUC16 | 3849416 | GGGCACATTTACCTTGGACACACCAACTACATCCTCCAGGGCAGGAACACACTCGATGGCGA
CTCAGGAATTTCCACACTCAGAAATGACCACTGTCATGAACAAGGACCCTGAGATTCTATCAT
GGACAATCCCTCCTTCTATAGAGAAAACCAGCTTCTCCTCTTCCCTGATGCCTTCACCAGCCAT
GACTTCACCTCCTGTTTCCTCAACATTACCAAAGACCATTCACACCACTCCTTCTCCTATGACCT
CACTGCTCACCCCTAGCCTAGTGATGACCACAGACACATTGGGCACAAGCCCAGAACCTACAA
CCAGTTCACCTCCAAATTTGAGCAGTACCTCACATGAGATACTGACAACAGATGAAGACACCA
CAGCTATAGAAGCCATGCATCCTTCCACAAGCACAGCAGCGACTAATGTGGAAACCACCAGTT
CTGGACATGGGTCACAATCCTCTGTCCTAGCTGACTCAGAAAAAACCAAGGCCACAGCTCCAA
TGGATACCACCTCCACCATGGGGCATACAACTGTTTCCACATCAATGTCTGTTTCCTCTGAGAC
TACAAAAATTAAGAGAGAGTCAACATATTCCTTGACTCCTGGACTGAGAGAGACCAGCATTTC |
| 3699 | MUC16 | 3849418 | CTCGTGTCCAGAGGATGAGCATCTCAGTTCCTGACATTTTAAGTACAAGTTGGACTCCCAGTA
GTACAGAAGCAGAAGATGTGCCTGTTTCAATGGTTTCTACAGATCATGCTAGTACAAAGACTG
ACCCAAATACGCCCTGTCCACTTTTCTGTTTGATTCTCTGTCCACTCTTGACTGGGACACTGG
GAGATCTCTGTCATCAGCCACAGCCACTACCTCAGCTCCTCAGGGGGCCACAACTCCCCAGGA
ACTCACTTTGGAAACCATGATCAGCCCAGCTACCTCACAGTTGCCCTTCTCTATAGGGCACATT
ACAAGTGCAGTCACACCAGCTGCAATGGCAAGGAGCTCTGGAGTTACTTTTTCAAGACCAGA
TCCCACAAGCAAAAGGCAGAGCAGACTTCCACTCAGCTTCCCACCACCACTTCTGCACATCC
AGGGCAGGTGCCCAGATCAGCAGCAACAACTCTGGATGTGATCCCACACACAGCAAAACTC
CAGATGCAACTTTTCAGAGACAAGGGCAGACAGCTCTTACAACAGAGGCAAGAGCTACATCT
GACTCCTGGAATGAGAAAGAAAAATCAACCCCAAGTGCACCTTGGATCACTGAGATGATGAA
TTCTGTCTCAGAAGATACCATCAAGGAGGTTACCAGCTCCTCCAGTGTATTAAGGACCCTGAA
TACGCTGGACATAAACTTGGAATCTGGGACGACTTCATCCCCAAGTTGGAAAAGCAGCCCATA
TGAGAGAATTGCCCCTTCTGAGTCCACCACAGACAAAGAGGCAATTCACCCTTCTACAAACAC
AGTAGAGACCACAGGCTGGGTCACAAGTTCCGAACATGCTTCTCATTCCACTATCCCAGCCCA
CTCAGCGTCATCCAAACTCACATCTCCAGTGGTTACAACCTCCACCAGGGAACAAGCAATAGT
TTCTATGTCAACAACCACATGGCCAGAGTCTACAAGGGCTAGAACAGAGCCTAATTCCTTCTT
GACTATTGAACTGAGGGACGTCAGCCCTTACATGGACACCAGCTCAACCACACAAACAAGTAT
TATCTCTTCCCCAGGTTCCACTGCGATCACCAAGGGGCCTAGAACAGAAATTACCTCCTCTAA
GAGAATATCCAGCTCATTCCTTGCCCAGTCTATGAGGTCGTCAGACAGCCCCTCAGAAGCCAT
CACCAGGCTGTCTAACTTTCCTGCCATGACAGAATCTGGAGGAATGATCCTTGCTATGCAAAC
AAGTCCACCTGGCGCTACATCACTAAGTGCACCTACTTTGGATACATCAGCCACAGCCTCCTG
GACAGGGACTCCACTGGCTACGACTCAGAGATTTACATACTCAGAGAAGACCACTCTCTTTAG
CAAAGGTCCTGAGGATACATCACAGCCAAGCCCTCCCTCTGTGGAAGAAACCAGCTCTTCCTC
TTCCCTGGTACCTATCCATGCTACAACCTCGCCTTCCAATATTTTGTTGACATCACAAGGGCAC
AGTCCCTCCTCTACTCCACCTGTGACCTCAGTTTTCTTGTCTGAGACCTCTGGCCTGGGGAAGA
CCACAGACATGTCGAGGATAAGCTTGGAACCTGGCACAAGTTTACCTCCCAATTTGAGCAGTA
CAGCAGGTGAGGCGTTATCCACTTATGAAGCCTCCAGAGATACAAAGGCAATTCATCATTCTG
CAGACACAGCAGTGACGAATATGGAGGCAACCAGTTCTGAATATTCTCCTATCCCAGGCCATA
CAAAGCCATCCAAAGCCACATCTCCATTGGTTACCTCCCACATCATGGGGACATCACTTCTTC
CACATCAGTATTTGGCTCCTCCGAGACCACAGAGATTGAGACAGTGTCCTCTGTGAACCAGGG
ACTTCAGGAGAGAAGCACATCCCAGGTGGCCAGCTCTGCTACAGAGACAAGCACTGTCATTA
CCCATGTGTCTAGTGGTGATGCTACTACTCATGTCACCAAGACACAAGCCACTTTCTCTAGCG
GAACATCCATCTCAAGCCCTCATCAGTTTATAACTTCTACCAACACATTTACAGATGTGAGCAC
CAACCCCTCCACCTCTCTGATAATGACAGAATCTTCAGGAGTGACCATCACCACCCAAACAGG
TCCTACTGGAGCTGCAACACAGGGTCCATATCTCTTGGACACATCAACCATGCCTTACTTGACA
GAGACTCCATTAGCTGTGACTCCAGATTTTACTGCAATCAGAGAAGACCACTCTCATAAGCAAA
GGTCCCAAGGATGTGTCCTGGACAAGCCCTCCCTCTGTGGCAGAAACCAGCTATCCCTCTTCC
CTGACACCTTTCTTGGTCACAACCATACCTCCTGCCACTTCCACGTTACAAGGGCAACATACAT
CCTCTCCTGTTTCTGCGACTTCAGTTCTTACCTCTGGACTGGTGAAGACCACAGATATGTTGAA
CACAAGCATGGAACCTGTGACCAATTCACCTCAAAATTTGAACAATTCATCAAATGAGATACT
GGCCACTTTGGCAGCCACCACAGATATAGAGACTATTCATCCTTCCATAAACAAAGCAGTGAC |

TABLE 13-continued

Subtyping Target Sequences

| SEQ ID NO. | Gene | Affy Probeset ID | Sequence |
|---|---|---|---|
| | | | CAATATGGGGACTGCCAGTTCAGCACATGTACTGCATTCCACTCTCCCAGTCAGCTCAGAACC |
| | | | ATCTACAGCCACATCTCCAATGGTTCCTGCCTCCAGCATGGGGGACGCTCTTGCTTCTATATCA |
| | | | ATACCTGGTTCTGAGACCACAGACATTGAGGGAGAGCCAACATCCTCCCTGACTGCTGGACG |
| | | | AAAAGAGAACAGCCACCCTCCAGGAGATGAACTCAACTACAGAGTCAAACATCATCCTCTCCAA |
| | | | TGTGTCTGTGGGGGCTATTACTGAAGCACAAAAATGGAAGTCCCCTCTTTTGATGCAACATT |
| | | | CATACCAACTCCTGCTCAGTCAACAAAGTTCCCAGATATTTTCTCAGTAGCCAGCAGTAGACTT |
| | | | TCAAACTCTCCTCCCATGACAATATCTACCCACATGACCACCACCCAGACAGGGTCTTCTGGAG |
| | | | CTACATCAAAGATTCCACTTGCCTTAGACACATCAACCTTGGAAACCTCAGCAGGGACTCCATC |
| | | | AGTGGTGACTGAGGGGTTTGCCCACTCAAAAATAACCACTGCAATGAACAATGATGTCAAGG |
| | | | ACGTGTCACAGACAAACCCTCCCTTTCAGGATGAAGCCAGCTCTCCCTCTTCTCAAGCACCTGT |
| | | | CCTTGTCACAACCTTACCTTCTTCTGTTGCTTTCACACCGCAATGGCACAGTACCTCCTCTCCTG |
| | | | TTTCTATGTCCTCAGTTCTTACTTCTTCACTGGTAAAGACCGCAGGCAAGGTGGATACAAGCTT |
| | | | AGAAACAGTGACCAGTTCACCTCAAAGTATGAGCAACACTTTGGATGACATATCGGTCACTTC |
| | | | AGCAGCCACCACAGATATAGAGACAACGCATCCTTCCATAAACACAGTAGTTACCAATGTGG |
| | | | GGACCACCGGTTCAGCATTTGAATCACATTCTACTGTCTCAGCTTACCCAGAGCCATCTAAAGT |
| | | | CACATCTCCAAATGTTACCACCTCCACCATGGAAGCACCACAATTTCCAGATCAATACCTAAA |
| | | | TCCTCTAAGACTACAAGAACTGAGACTGAGCAACTTCCTCCCTGACTCCTAAACTGAGGGAG |
| | | | ACCAGCATCTCCCAGGAGATCACCTCGTCACAGAGACAAGCACTGTTCCTTACAAAGAGCTC |
| | | | ACTGGTGCCACTACCGAGGTATCCAGGACAGATGTCACTTCCTCTAGCAGTACATCCTTCCCT |
| | | | GGCCCTGATCAGTCCACAGTGTCACTAGACATCTCCACAGAAACCAACACCAGGCTGTCTACC |
| | | | TCCCCAATAATGACAGAATCTGCAGAAATAACCATCACCACCCAAACAGGTCCTCATGGGGCT |
| | | | ACATCACAGGATACTTTTACCATGGACCCATCAAATACAACCCCCCAGGCAGGGATCCACTCA |
| | | | GCTATGACTCATGGATTTTCACAATTGGATGTGACCACTCTTATGAGCAGAATTCCACAGGAT |
| | | | GTATCATGGACAAGTCCTCCCTCTGTGGATAAAACCAGCTCCCCCTCTTCCTTTCTGTCCTCACC |
| | | | TGCAATGACCACACCTTCCCTGATTTCTTCTACCTTACCAGAGGATAAGCTCTCCTCTCCTATGA |
| | | | CTTCACTTCTCACCTCTGGCCTAGTGAAGATTACAGACATATTACGTACACGCTTGGAACCTGT |
| | | | GACCAGCTCACTTCCAAATTTCAGCAGCACCTCAGATAAGATACTGGCCACTTCTAAAGACAG |
| | | | TAAAGCACAAAGGAAATTTTTCCTTCTATAAACACAGAAGAGACCAATGTGAAAGCCAACA |
| | | | ACTCTGGACATGAATCCCATTCCCCTGCACTGGCTGACTCAGAGACACCCAAAGCCACAACTC |
| | | | AAATGGTTATCACCACCACTGTGGGAGATCCAGCTCCTTCCACATCAATGCCAGTGCATGGTT |
| | | | CCTCTGAGACTACAAACATTAAGAGAGCCAACATATTTCTTGACTCCTAGACTGAGAGAGA |
| | | | CCAGTACCTCTCAGGAGTCCAGCTTTCCCACGGACACAAGTTTTCTACTTTTCCAAAGTCCCCAC |
| | | | TGGTACTATTACTGAGGTCTCCAGTACAGGGGTCAACTCTTCTAGCAAAATTTCCACCCCAGA |
| | | | CCATGATAAGTCCACAGTGCCACCTGACACCTTCACAGGAGAGATCCCCAGGGTCTTCACCTC |
| | | | CTCTATTAAGACAAAATCTGCAGAAATGACGATCACCACCCAAGCAAGTCCTCCTGAGTCTGC |
| | | | ATCGCACAGTACCCTTCCCTTGGACACATCAACCACACTTTCCCAGGGAGGGACTCATTCAACT |
| | | | GTGACTCAGGGATTCCCATACTCAGAGGTGACCACTCTCATGGGCATGGGTCCTGGGAATGT |
| | | | GTCATGGATGACAACTCCCCCTGTGGAAGAAACCAGCTCTGTGTCTTCCCTGATGTCTTCACCT |
| | | | GCCATGACATCCCCTTCTCCTGTTTCCTCCACATCACCACAGAGCATCCCCTCCTCTCCTCTTCCT |
| | | | GTGACTGCACTTCCTACTTCTGTTCTGGTGACAACCACAGATGTGTTGGGCACAACAAGCCCA |
| | | | GAGTCTGTAACCAGTTCACCTCCAAATTTGAGCAGCATCACTCATGAGAGACCGGCCACTTAC |
| | | | AAAGACACTGCACACACAGAAGCCGCCATGCATCATTCCACAAACACCGCAGTGACCAATGT |
| | | | AGGGACTTCCGGGTCTGGACATAAATCACAATCCTCTGTCCTAGCTGACTCAGAGACATCGAA |
| | | | AGCCACACCTCTGATGAGTACCACCTCCACCCTGGGGGACAAGTGTTTCCACATCAACTCC |
| | | | TAATATCTCTCAGACTAACCAAATTCAAACAGAGCCAACAGCATCCCTGAGCCCTAGACTGAG |
| | | | GGAGAGCAGCACGTCTGAGAAGACCAGCTCAACAACAGAGACAAATACTGCCTTTTCTTATG |
| | | | TGCCCACAGGTGCTATTACTCAGGCCTCCAGAACAGAAATCTCCTCTAGCAGAACATCCATCT |
| | | | CAGACCTTGATCGGCCCACAATAGCACCCGACATCTCCACAGGAATGATCACCAGGCTCTTCA |
| | | | CCTCCCCCATCATGACAAAATCTGCAGAAATGACCGTCACCACTCAAACAACTACTCCTGGGG |
| | | | CTACATCACAGGGTATCCTTCCCTGGGACACATCAACCACACTTTTCCAGGGAGGGACTCATT |
| | | | CAACCGTGTCTCAGGGATTCCCACACTCAGAGATAACCACTCTTCGGAGCAGAACCCCTGGAG |
| | | | ATGTGTCATGGATGACAACTCCCCCTGTGGAAGAAACCAGCTCTGGGTTTTCCCTGATGTCAC |
| | | | CTTCCATGACATCCCCTTCTCCTGTTTCCTCCACATCACCAGAGAGCATCCCCTCCTCTCCTCTCC |
| | | | CTGTGACTGCACTTCTTACTTCTGTTCTGGTGACAACCACAAATGTATTGGGCACAACAAGCCC |
| | | | AGAGCCCGTAACGAGTTCACCTCCAAATTTAAGCAGCCCACACAGGAGAGACTGACCACTTA |
| | | | CAAAGACACTGCGCACACAGAAGCCATGCATGCTTCCATGCATACAAACACTGCAGTGGCCA |
| | | | ACGTGGGGACCTCCATTTCTGGACATGAATCACAATCTTCTGTCCCAGCTGATTCACACACATC |
| | | | CAAAGCCACATCTCCAATGGGTATCACCTTCGCCATGGGGGATACAAGTGTTTCTACATCAAC |
| | | | TCCTGCCTTCTTTGAGACTAGAATTCAGACTGAATCAACATCCTCTTTGATTCCTGGATTAAGG |
| | | | GACACCAGGACGTCTGAGGAGATCAACACTGTGACAGAGACCAGCACTGTCCTTTCAGAAGT |
| | | | GCCCACTACTACTACTACTGAGGTCTCCAGGACAGAAGTTTATCACTTCCAGCAGAACAACCAT |
| | | | CTCAGGGCCTGATCATTCCAAAATGTCACCCTACATCTCCACAGAAACCATCACCAGGCTCTCC |
| | | | ACTTTTCCTTTTGTAACAGGATCCACAGAAATGGCCATCACCAACCAAACAGGTCCTATAGGG |
| | | | ACTATCTCACAGGCTACCCTTACCCTGGACACATCAAGCACAGCTTCCTGGGAAGGGACTCAC |
| | | | TCACCTGTGACTCAGAGATTTCCACACTCAGAGGAGACCACTACTATGAGCAGAAGTACTAAG |
| | | | GGCGTGTCATGGCAAAGCCCTCCCTCTGTGGAAGAAACCAGTTCTCCTTCTTCCCCAGTGCCTT |
| | | | TACCTGCAATAACCTCACATTCATCTCTTTATTCCGCAGTATCAGGAAGTAGCCCCACTTCTGCT |
| | | | CTCCCTGTGACTTCCCTTCTCACCTCTGGCAGGAGGAAGACCATAGACATGTTGGACACACAC |
| | | | TCAGAACTTGTGACCAGCTCCTTACCAAGTGCAAGTAGCTTCTCAGGTGAGATACTCACTTCT |
| | | | GAAGCCTCCACAAATACAGAGACAATTCACTTTTCAGAGAACACAGCAGAAACCAATATGGG |
| | | | GACCACCAATTCTATGCATAAACTACATTCCTCTGTCTCAATCCACTCCCAGCCATCCGGACAC |
| | | | ACACCTCCAAAGGTTACTGGATCTATGATGGAGGACGCTATTGTTTCCACATCAACACCTGGT |
| | | | TCTCCTGAGACTAAAAATGTTGACAGAGACTCAACATCCCCTCTGACTCCTGAACTGAAAGAG |
| | | | GACAGCACCGCCCTGGTGATGAACTCAACTACAGAGTCAAACACTGTTTTCTCCAGTGTGTCC |

TABLE 13-continued

Subtyping Target Sequences

| SEQ ID NO. | Gene | Affy Probeset ID | Sequence |
|---|---|---|---|
| | | | CTGGATGCTGCTACTGAGGTCTCCAGGGCAGAAGTCACCTACTATGATCCTACATTCATGCCA<br>GCTTCTGCTCAGTCAACAAAGTCCCCAGACATTTCACCTGAAGCCAGCAGCAGTCATTCTAACT<br>CTCCTCCCTTGACAATATCTACACACAAGACCATCGCCACACAAACAGGTCCTTCTGGGGTGA<br>CATCTCTTGGCCAACTGA |
| 3700 | MUC16 | 3849421 | GTTCTCCAGAAACATGGGCAAGCTCTATTTCAGTTCC |
| 3701 | MUC16 | 3849422 | GCAAGGTCTGGTTCTAGTTCCTCTCCCATAAGCCTATCCACTGAGAAAGAAACAAGCTTCCTTT<br>CCCCCACTGCATCCACCTCCAGAAAGACTTCACTATTTCTTGGGCCTTCCATGGCAAGGCAGCC<br>CAACATATTGGTGCATCTTCAGACTTCAGCTCTGACACTTTCTCCAACATCCACTCTAAATATGT<br>CCCAGGAGGAGCCTCCTGAGTTAACCTCAAGCCAGACCATTG |
| 3702 | MUC16 | 3849423 | AACAGGGGACCCTAGATATGCCTCAGAGAGCATGTCTTATCCAGACCCAAGCAAGGCATCAT<br>CAGCTATGACATCGACCTCTCTTGCATCAAAA |
| 3703 | MUC16 | 3849424 | TACTCAATCAACAGCACCCAAAGGGATACCTGTGAAGCCCACCAGTGCTGAGTCAGGCCTCCT<br>AACACCTGTCTCTGCCTCCTCAAGCCCATCAAAGGCCTTTGCCTCACTGACTACAGCTCCCCCA<br>ACTTGGGGGATCCCACAGTCTACCTTGACATTTGAGTTTTCTGAGGTCCCAAGTTTGGATACTA<br>AGTCCGCTTCTTTACCAACTCCTGGACAGTCCCTGAACACCATTCCAGACTCAGATGCAAGCAC<br>AGCATCTTCCTCACTGTCCAAGTCTCCAGAAAAAAAACCCAAGGGCAAGGATGATGACTTCCAC<br>AAAGGCCATAAGTGCAAGCTCATTTCA |
| 3704 | MUC16 | 3849425 | TTGGCCAGTCCTACATCTTCGGTTGTGGGAAGAACCACCCAGTCTTTGGGGGTGATGTCCTCT<br>GCTCTCCCTGAGTCAACCTCTAGAGGAATGACACACTCCGAGCAAAGAACCAGCCCATCGCTG<br>AGTCCCCAGGTCAATGGAACTCCCTCTAGGAACTACCCTGCTACAAGCATGGTTTCAGGATTG<br>AGTTCCCCAAGGACCAGGACCAGTTCCACAGAAGGAAATTTTACCAAAGAAGCATCTACATAC<br>ACACTCACTGTAGAGACCACAAGTGGCCCAGTCACTGAGAAGTACACAGTCCCCACTGAGAC<br>CTCAACAACTGAAGGTGACAGCACAGAGACCCCCTGGGACACAAGATATATTCCTGTAAAAA<br>TCACATCTCCAATGAAAACATTTGCAGATTCAACTGCATCCAAGGAAAATGCCCCAGTGTCTAT<br>GACTCCAGCTGAGACCACAGTTACTGACTCACATACTCCAGGAAGGACAAACCCATCATTTGG<br>GACACTTTATTCTTCCTTCCTTGACCTATCACCTAAAGGGACCCCAAATTCCAGAGGTGAAACA<br>AGCCTGGAACTGATTCTATCAACCACTGGATATCCCTTCTCCTCTCCTGAACCTGGCTCTGCAG<br>GACACAGCAGAATAAGTACCAGTGCGCCTTTGTCATCATCTGCTTCAGTTCTCGATAATAAAA<br>TATCAGAGACCAGCATATTCTCAGGCCAGAGTCTCACCTCCCCTCTGTCTCCTGGGGTGCCCG<br>AGGCCAGAGCCAGCACAATGCCCAACTCAGCTATCCCTTTTTCCATGACACTAAGCAATGCAG<br>AAACAAGTGCCGAAAGGGTCAGAAGCACAATTTCCTCTCTGGGGACTCCATCAATATCCACAA<br>AGCAGACAGCAGAGACTATCCTTACCTTCCATGCCTTCGCTGAGACCATGGATATACCCAGCA<br>CCCACATAGCCAAGACTTTGGCTTCAGAATGGTTGGGAAGTCCAGGTACCCTTGGTGGCACC<br>AGCACTTCAGCGCTGACAACCACATCTCCATCTACCACTTTAGTCTCAGAGGAGACCAACACC<br>CATCACTCCACGAGTGGAAAGGAAACAGAAGGAACTTTGAATACATCTATGACTCCACTTGA<br>GACCTCTGCTCCTGGAGAAGAGTCCGAAATGACTGCCACCTTGGTCCCCACTCTAGGTTTTAC<br>AACTCTTGACAGCAAGATCAGAAGTCCATCTCAGGTCTCTTCATCCCACCCAACAAGAGAGCT<br>CAGAACCACAGGCAGCACCTCTGGGAGGCAGAGTTCCAGCACAGCTGCCCACGGGAGCTCT<br>GACATCCTGAGGGCAACCACTTCCAGCACCTCAAAAGCATCATCATGGACCAGTGAAAGCAC<br>AGCTCAGCAATTTAGTGAACCCCAGCACACACAGTGGGTGGAGACAAGTCCTAGCATGAAAA<br>CAGAGAGACCCCCAGCATCAACCAGTGTGGCAGCCCCTATCACCACTTCTGTTCCCTCAGTGG<br>TCTCTGGCTTCACCACCCTGAAGACCAGCTCCACAAAAGGGATTTGGCTTGAAGAAACATCTG<br>CAGACACACTCATCGGAGAATCCACAGCTGGCCCAACCACCCATCAGTTTGCTGTTCCCACTG<br>GGATTTCAATGACAGGAGGCAGCAGCACCAGGGGAAGCCAGGGCACAACCCACCTACTCAC<br>CAGAGCCACAGCATCATCTGAGACATCCGCAGATTTGACTCTGGCCACGAACGGTGTCCCAGT<br>CTCCGTGTCTCCAGCAGTGAGCAAGACGGCTGCTGGCTCAAGTCCTCCAGGAGGGACAAAGC<br>CATCATATACAATGGTTTCTTCTGTCATCCCTGAGACATCATCTCTACAGTCCTCAGCTTTCAGG<br>GAAGGAACCAGCCTGGGACTGACTCCATTAAACACTAGACATCCCTTCTCTTCCCCTGAACCA<br>GACTCTGCAGGACACACCAAGATAAGCACCAGCATTCCTCTGTTGTCATCTGCTTCAGTTCTTG<br>AGGATAAAGTGTCAGCGACCAGCACATTCTCACACCACAAAGCCACCTCATCTATTACCACAG<br>GGATTCCTGAAATCTCAACAAAGACAAAGCCCAGCTCAGCCGTTCTTTCCTCCATGACCCTAA<br>GCAATGCAGCAACAAGTCCTGAAAGAGTCAGAAATGCAACTTCCCCTCTGACTCATCCATCTC<br>CATCAGGGGAAGAGACAGCAGGGAGTGTCCTCACTCTCAGCACCTCTGCTGAGACTACAGAC<br>TCACCTAACATCCACCCAACTGGGACACTGACTTCAGAATCGTCAGAGAGTCCTAGCACTCTC<br>AGCCTCCCAAGTGTCTCTGGAGTCAAAACCACATTTTCTTCATCTACTCCTTCCACTCATCTATT<br>TACTAGTGGAGAAGAAACAGAGGAAACTTCGAATCCATCTGTGTCTCAACCTGAGACTTCTGT<br>TTCCAGAGTAAGGACCACCTTGGCCAGCACCTCTGTCCCTACCCCAGTATTCCCACCATGGAC<br>ACCTGGCCTACACGTTCAGCTCAGTTCTCTTCATCCCACCTAGTGAGTGAGCTCAGAGCTACG<br>AGCAGTACCTCAGTTACAAACTCAACTGGTTCAGCTCTTCCTAAAATATCTCACCTCACTGGGA<br>CGGCAACAATGTCACAGACCAATAGAGACACGTTTAATGACTCTGCTGCACCCCAAAGCACAA<br>CTTGGCCAGAGACTAGTCCCAGATTCAAGACAGGGTTACCTTCAGCAACAACCACTGTTTCAA<br>CCTCTGCCACTTCTCTCTCTGCTACTGTAATGGTCTCTAAATTCACTTCTCCAGCAACTAGTTCC<br>ATGGAAGCAACTTCTATCAGGGAACCATCAACAACCATCCTCACAACAGAGACCACGAATGG<br>CCCAGGCTCTATGCTGTGGCTTCTACCAACATCCCAATTGGAAAGGGCTACATTACTGAAGG<br>AAGATTGGACACAAGCCATCTGCCCATTGGAACCACAGCTTCCTCTGAGACATCTATGGATTT<br>TACCATGGCCAAAGAAAGTGTCTCAATGTCAGTATCTCCATCTCAGTCCATGGATGCTGCTGG<br>CTCAAGCACTCCAGGAAGGACAAGCCAATTCGTTGACACATTTTCTGATGATGTCTATCATTTA<br>ACATCCAGAGAAATTACAATACCTAGAGATGGAACAAGCTCAGCTCTGACTCCACAAATGACT<br>GCAACTCACCCTCCATCTCCTGATCCTGGCTCTGCTAGAAGCACCTGGCTTGGCATCTTGTCCT |

TABLE 13-continued

Subtyping Target Sequences

| SEQ ID NO. | Gene | Affy Probeset ID | Sequence |
|---|---|---|---|
| | | | CATCTCCTTCTTCTCCTACTCCCAAAGTCACAATGAGCTCCACATTTTCAACTCAGAGAGTCACC
ACAAGCATGATAATGGACACAGTTGAAACTAGTCGGTGGAACATGCCCAACTTACCTTCCACG
ACTTCCTTGACACCAAGTAATATTCCAACAAGTGGTGCCATAGGAAAAAGCACCCTGGTTCCC
TTGGACACTCCATCTCCAGCCACATCATTGGAGGCATCAGAAGGGGGACTTCCAACCCTCAGC
ACCTACCCTGAATCAACAAACACACCCAGCATCCACCTCGGAGCACACGCTAGTTCAGAAAGT
CCAAGCACCATCAAACTTACCATGGCTTCAGTAGTAAAACCTGGCTCTTACACACCTCTCACCT
TCCCCTCAATAGAGACCCACATTCATGTATCAACAGCCAGAATGGCTTACTCTTCTGGGTCTTC
ACCTGAGATGACAGCTCCTGGAGAGACTAACACTGGTAGTACCTGGGACCCCACCACCTACAT
CACCACTACGGATCCTAAGGATACAAGTTCAGCTCAGGTCTCTACACCCCACTCAGTGAGGAC
ACTCAGAACCACAGAAAACCATCCAAAGACAGAGTCCGCCACCCCAGCTGCTTACTCTGGAA
GTCCTAAAATCTCAAGTTCACCCAATCTCACCAGTCCGGCCACAAAAGCATGGAACCATCACAG
ACACAACTGAACACTCCACTCAATTACATTACACAAAATTGGCAGAAAAATCATCTGGATTTG
AGACACAGTCAGCTCCAGGACCTGTCTCTGTAGTAATCCCTACCTCCCCTACCATTGGAAGCA
GCACATTGGAACTAACTTCTGATGTCCCAGGGGAACCCCTGGTCCTTGCTCCCAGTGAGCAGA
CCACAATCACTCTCCCCATGGCAACATGGCTGAGTACCAGTTTGACAGAGGAAATGGCTTCAA
CAGACCTTGATATTTCAAGTCCAAGTTCACCCATGAGTACATTTGCTATTTTTCCACCTATGTCC
ACACCTTCTCATGAACTTTCAAAGTCAGAGGCAGATACCAGTGCATTAGAAATACAGATTCA
ACAACGTTGGATCAGCACCTAGGAATCAGGAGTTTGGGCAGAACTGGGGACTTAACAACTGT
TCCTATCACCCCACTGACAACCACGTGGACCAGTGTGATTGAACACTCAACACAAGCACAGGA
CACCCTTTCTGCAACGATGAGTCCTACTCACGTGACACAGTCACTCAAAGATCAAACATCTATA
CCAGCCTCAGCATCCCCTTCCCATCTTACTGAAGTCTACCCTGAGCTCGGGACACAAGGGAGA
AGCTCCTCTGAGGCAACCACTTTTTGGAAACCATCTACAGACACACTGTCCAGAGAGATTGAG
ACTGGCCCAACAAACATTCAATCCACTCCACCCATGGACAACACAACAACAGGGAGCAGTAG
TAGTGGAGTCACCCTGGGCATAGCCCACCTTCCCATAGGAACATCCTCCCCAGCTGAGACATC
CACAAACATGGCACTGGAAAGAAGAAGTTCTACAGCCACTGTCTCTATGGCTGGGACAATGG
GACTCCTTGTTACTAGTGCTCCAGGAAGAAGCATCAGCCAGTCATTAGGAAGAGTTTCCTCTG
TCCTTTCTGAGTCAACTACTGAAGGAGTCACAGATTCTAGTAAGGGAAGCAGCCCAAGGCTG
AACACACAGGGAAATACAGCTCTCTCCTCCTCTCTTGAACCCAGCTATGCTGAAGGAAGCCAG
ATGAGCACAAGCATCCCTCTAACCTCATCTCCTACAACTCCTGATGTGGAATTCATAGGGGGC
AGCACATTTTGGACCAAGGAGGTCACCACAGTTATGACCTCAGACATCTCCAAGTCTTCAGCA
AGGACAGAGTCCAGCTCAGCTACCCTTATGTCCACAGCTTTGGGAAGCACTGAAAATACAGG
AAAAGAAAAACTCAGAACTGCCTCTATGGATCTTCCATCTCCAACTCCATCAATGGAGGTGAC
ACCATGGATTTCTCTCACTCTCAGTAATGCCCCAATACCACAGATTCACTTGACCTCAGCCAT
GGGGTGCACACCAGCTCTGCAGGGACTTTGGCCACTGACAGGTCATTGAATACTGGTGTCAC
TAGAGCCTCCAGATTGGAAAACGGCTCTGATACCTCTTCTAAGTCCCTGTCTATGGGAAACAG
CACTCACACTTCCATGACTTACACAGAGAAGAGTGAAGTGTCTTCTTCAATCCATCCCCCGACCT
GAGACCTCAGCTCCTGGAGCAGAGACCACTTTGACTTCCACTCCTGGAAACAGGGCCATAAG
CTTAACATTGCCTTTTTCATCCATTCCAGTGGAAGAAGTCATTTCTACAGGCATAACCTCAGGA
CCAGACATCAACTCAGCACCCATGACACATTCTCCCATCACCCCACCAACAATTGTATGGACCA
GTACAGGCACAATTGAACAGTCCACTCAACCACTACATGCAGTTTCTTCAGAAAAAGTTTCTG
TGCAGACACAGTCAACTCCATATGTCAACTCTGTGGCAGTGTCTGCTTCCCCTACCCATGAGA
ATTCAGTCTCTTCTGGAAGCAGCACATCCTCTCCATATTCCTCAGCCTCACTTGAATCCTTGGAT
TCCACAATCAGTAGGAGGAATGCAATCACTTCCTGGCTATGGGACCTCACTACATCTCTCCCC
ACTACAACTTGGCCAAGTACTAGTTTATCTGAGGCACTGTCCTCAGGCCATTCTGGGGTTTCA
AACCCAAGTTCAACTACGACTGAATTTCCACTCTTTTCAGCTGCATCCACATCTGCTGCTAAGC
AAAGAAATCCAGAAACAGAGACCCATGGTCCCCAGAATACAGCCGCGAGTACTTTGAACACT
GATGCATCCTCGGTCACAGGTCTTTCTGAGACTCCTGTGGGGGCAAGTATCAGCTCTGAAGTC
CCTCTTCCAATGGCCATAACTTTCTAGATCAGATGTTTCTGGCCTTACATCTGAGAGTACTGCTA
ACCCGAGTTTAGGCACAGCCTCTTCAGCAGGGACCAAATTAACTAGGACAATATCCCTGCCCA
CTTCAGAGTCTTTGGTTTCCTTTAGAATGAACAAGGATCCATGGACAGTGTCAATCCCTTTGG
GGTCCCATCCAACTACTAATACAGAAACAAGCATCCCAGTAAACAGCGCAGGTCCACCTGGCT
TGTCCACAGTAGCATCAGATGTAATTGACACACCTTCAGATGGGGCTGAGAGTATTCCCACTG
TCTCCTTTTCCCCCTCCCCTGATACTGAAGTGACAACTATCTCACATTTCCCAGAAAAGACAACT
CATTCATTTAGAACCATTTCATCTCTCACTCATGAGTTGACTTCAAGAGTGACACCTATTCCTG
GGGATTGGATGAGTTCAGCTATGTCTACAAAGCCCACAGGAGCCAGTCCCTCCATTACACTGG
GAGAGAGAAGGACAATCACCTCTGCTGCTCCAACCACTTCCCCCATAGTTCTCACTGCTAGTTT
CACAGAGACCAGCACAGTTTCACTGGATAATGAAACTACAGTAAAAACCTCAGATATCCTTGA
CGCACGGAAAACAAATGAGCTCCCCTCAGATAGCAGTTCTTCTTCTGATCTGATCAACACCTCC
ATAGCTTCTTCAACTATGGATGTCACTAAAACAGCCTCCATCAGTCCCACTAGCATCTCAGGAA
TGACAGCAAGTTCCTCCCCATCTCTCTTCTTCAGATAGACCCCAGGTTCCCACATCTACAAC
AGAGACAAATCAGCCACCTCTCCATCTGTTTCCAGTAACACCTATTCTCTTGATGGGGGCTCC
AATGTGGGTGGCACTCCATCCACTTTACCACCCTTTACAATCACCCACCCTGTCGAGACAAGCT
CGGCCCTATTAGCCTGGTCTAGACCAGTAAGAACTTTCAGCACCATGGTCAGCACTGACACTG
CCTCCGGAGAAAATCCTACCTCTAGCAATTCTGTGGTGACTTCTGTTCCAGCACCAGGTACAT
GGACCAGTGTAGGCAGTACTACTGACTTACCTGCCATGGGCTTTCTCAAGACAAGTCCTGCAG
GAGAGGCACACTCACTTCTAGCATCAACTATTGAACCAGCCACTGCCTTCACTCCCCATCTCTC
AGCAGCAGTGGTCACTGGATCCAGTGCTACATCAGAAGCCAGTCTTCTCACTACGAGTGAAA
GCAAAGCCATTCATTCTTCACCACAGACCCCAACTACACCCACCTCTGGAGCAAACTGGGAAA
CTTCAGCTACTCCTGAGAGCCTTTTGGTAGTCACTGAGCACAACACTTACCTCAAA
GATTTTGGTCACAGATACCATCTTGTTTTCAACTGTGTCCACGCCACCTTCTAAATTTCCAAGTA
CGGGGACTCTGTCTGGAGCTTCCTTCCCTACTTTACTCCCGGACACTCCAGCCATCCCTCTCAC
TGCCACTGAGCCAACAAGTTCATTAGCTACATCCTTTGATTCCACCCCACTGGTGACTATAGCT
TCGGATA |

TABLE 13-continued

Subtyping Target Sequences

| SEQ ID NO. | Gene | Affy Probeset ID | Sequence |
|---|---|---|---|
| 3705 | MUC16 | 3849426 | GCAGGAGCACTAAAGCCACACCAGAAATGGATTCAGGACTGACAGGAGCCACCTTGTCACCT AAGACATCTACAGGTGCAATCGTGGTGACAGAACA |
| 3706 | MUC16 | 3849427 | CCTGGGTCATCTTCTCCCACCCGCT |
| 3707 | ZNF91 | 3857041 | TTGGCTTTTCTACCCCAATTCAAGAAGTCACTTCTTCAGTCAACCAAACCAATTACAAAATTGT GTTCCAATGTCACATGTTCAAAAATA |
| 3708 | ZNF91 | 3857045 | GGTTGATGGGCCCAGAGATATATCACATTGCCCCTTGTGGACAGGGACCAGGCAGGGGACTC ACATCACAATAGAGGTAGGACAAGGAATACATCACAATACGTTTTGAGAGCAGAACCAAAAA AGAGTAACATAATCTTTGTGTTGAGTGCAGCA |
| 3709 | ZNF91 | 3857047 | GAGAGAAGGGTCATATCACCTAAGCTCTGGATTCGCAGATAGGCCCCAATCTCTTTTTTGGGC AATGCTCGG |
| 3710 | ZNF91 | 3857049 | CACCCTAGTGGGCAGGTCCATTAAAGAGAAGGCTGTCAAAGCACATAGATGCTGGGCAAAGT GATATGTCATAATCCCCATGATGATAGGCCCAGAGACATGTCACAATGACCTCTTTAGGCAGA GACCAGGCAGAAGAATCACATCACTTGTGTGCTGGCCCTAGTGATAAGTCACTCTCATTTCTG TGGACATGGCCCAGGCAGAAGAGCAGAGTCACATTACCTAAGCGCTGGGTCAAGAGATATGT CACAATCTTTTACATGGGCAAAACCCAGGTAAAAAGAGGAGTAATATCAGATAGTAGGTGT TGCCAGAGATATGTCAAATGCCCCTGTATGAAAGACTCAGGCAGTCAAAACACATTAGTTG GTTTCTTAACCTAGTGATATGTTATAATCTTTCCTGTGGGTATGATGCAGGCAGAAGACGAGA GTCATGTGATGATGCAGAGACATGTCACAAGGTCTTCTGTGGGCAGGGTCCAGACTGAAGC CTTCCACCTGCTAGGGGTTGAGCCCAATGATATGTCACAATACCCAAATTATGCAGGGCCCAG GCAAAAAAACGAGAGGCACATCACCTGGGTTCTGGATCCAATGATATATCACAATTTTCTAT TTTGGCAAGACCCAGGCAGAAAGAAAAGTTACATCACCTAGGTGATGAATGAAAATACATAT TATAATAGTTTTGTGGGCAGGACCCATGCGGGAGAGTCACATCACCTAGGTGTTGGACCCAG AAATATGTCACAATATACAGTGTATACAGAGCTGAGGCATGAGACAATAGTAACTTCACTCAT TTGTTGAGCCCAGCTATACAATCCTTTTTTGGGCACAGCCGA |
| 3711 | ZNF91 | 3857051 | ATTATTCTCCTTTGGGCAGTGCTTCTGCAGAAAAGTTGCACCTTCTAGGTGTTGGACTCAGCAA TATATCACAATGTCTGCAGTATTTTGGAAGGAGAGGAGAGTCACCATTACTTA |
| 3712 | ZNF91 | 3857070 | GCCCAGTCTAGTGGTAATTAGTTTCCCCAGCATTTATTTGTCAGGGTAAGACTTTATATTCTTC ATTTGTGAAGGTTATTCTAGCTTGATATAAAATTTTTGGCTGGCAGTTTTCTTTTTTTTCAACAC TCTAAAAGTGCCATCCCATTCTCTTCTGGTCAGTAAAGTTTCTGCTGAGAAGTCTGCTTTTAAT CTAATGTGGTTTTCTTTATAAATTACTAGATGCTTTTCTTTTGCTTATTTTAGAATTACTTCCTTC ACTTTGACTTTAGATATTCTGATTATCATGTGCCATTATGATGTCTGTTTTGCAATATATTTTGT TTATATTTTGTTGTATTTTGTTTGCTGAGCTTCCTGTGTATGTATGTCTAATTCTATTGCTAGAG TTGGAAAGTTTTCA |
| 3713 | ZNF91 | 3857072 | ACCGCACCCAACCAAATCTATACATT |
| 3714 | ZNF91 | 3857074 | GCGCGATCTCGTCCCACTGCTCACTGC |
| 3715 | ZNF91 | 3857096 | TAATGGACTGACATCTCTAGTGATTTTTTTGCCAGTGAGTTTTAATTGCCATTAAGTTAAAGA ATATTGTTCCCATAGGCTAAATTTTTATTTTTATTTTCTCATTTAAATGTATTTGACTTAATTTTT GTGGATACCTAATATGTGTACATATTATGCCATATGTGGCATATTTTGATACGGACACACAAT ATATAACAATCGCATTAGACTAAATGCGGTCTCCATTACCTCTAGC |
| 3716 | ZNF91 | 3857098 | GCTTTGAACTAATGCTCACACCTTAATGCATAGGAAAGCATTTATGCTTGAGAAAAAGTGAAC AAATATAGACAAAAAGCCATTAATACCTGCTCACATCGTACTCAAATTCAGAGCGTTCATACTA AATAAGAAGTGTAATTACTGTCAAACGACTGATC |
| 3717 | ZNF91 | 3857100 | GATGTGCCAACGCTTTTGACAAGTCAAACTTT |
| 3718 | ZNF91 | 3857102 | GTGTGAATAATGTGGTAAAGTCTATAAAAAGTCCTGAATTCTTAACAG |
| 3719 | ZNF91 | 3857104 | GCAAATCCTTTTTCTGGTCCTCAGCCCTAACCAGACATAAGAAAATTCATACTGGACAGCAACC CTACAAACAGGAA |
| 3720 | ZNF91 | 3857106 | AGAAAATTCATACTATCACACCTGTA |
| 3721 | ZNF91 | 3857107 | GTCCTCAGCTCTTACTAAACATAAGATAAT |
| 3722 | ZNF91 | 3857108 | TTTATATCATCCTCAACCCTAAATG |
| 3723 | ZNF91 | 3857109 | CATTTAGCCAGCCTTCACACCTTACTACACATAAGAGGATGCACACTGGAGAGAAACCCTACA AATGTGAAGAATGTGGCAAAGCTTTTAGCCAATCCTCAACCCTTACTACACATAAGATAATTC ATACTGGAGAGAAACCCTACAAATGTGAAGAATGTGGCAAAGCTTTTAGGAAATCTTCAACTC TTACTGAACATAAGATAATTCATACTGGAGAGAAACCCTACAAATGTGAAGAATGTGGCAAA GCATTTAGCCAATCCTCAACCCTAACTAGACATACGAGGATGCACACTGG |
| 3724 | ZNF91 | 3857110 | AGAGAAAACCTACAAATGTGAAGAATGTG |

TABLE 13-continued

Subtyping Target Sequences

| SEQ ID NO. | Gene | Affy Probeset ID | Sequence |
|---|---|---|---|
| 3725 | ZNF91 | 3857111 | ATCAATCTTCAAATCTTACGACACATAAGATAATTCATACTAAAGAGAAACCTTCCAAGAGTGAAGAATGTGACAAAGCATTTATCTGGTCCTCAAC |
| 3726 | ZNF91 | 3857112 | GGCAAAGCTTTTAAGCACTCCTCAG |
| 3727 | ZNF91 | 3857113 | GGCAAAGCTTTTAGCCGTTCCTCAACCCTTACTAAGCATAAGACAATTC |
| 3728 | ZNF91 | 3857114 | AACTAGACATAAGAGGATACACACT |
| 3729 | ZNF91 | 3857115 | TGACAAAACTTTTAAGCGACTCTCAA |
| 3730 | ZNF91 | 3857116 | AACTAGACATAAGAGGATACACACT |
| 3731 | ZNF91 | 3857117 | TTTAGCCGTTCTTCAACCCTTGCTAAACATAAGAGAATTCATACTGGAGAGAAACCCTACAAATGTAAAGAATGTGGCAAAGCTTTTAGCAATTCCTCAACCCTTGCTAATCATAAGATAACTCATACTGAAGAGAAACCCTACAAATGTAAAGAATGTGACAAAGCTTTTAAGCGACTCTCAACCCTT |
| 3732 | ZNF91 | 3857118 | AACTAGACATAAGAGGATACACACT |
| 3733 | ZNF91 | 3857119 | ACCCAACATAAATGCGTTTATATTACA |
| 3734 | ZNF91 | 3857120 | GTGGGAAATATTTGAAAGTCTTCTATAAATTTTTAAATTCAAACAGACATACGATAAGACATACTGGAAAGAAATGCTTCAAATGTAAAAAATGTGTCAAGTCATTTTGCATCC |
| 3735 | ZNF91 | 3857121 | TTCAAAAAGTATTACTGAGAAAATATGAAAAATGTGGACATGAGAATTTACAGTTAAGAAAAGGTTGTAAAAGTGTGGATGAGTGTAAGGTGCACAAAGAAGGTTATAATAAACTTAACCAGTGTCTCACAACTGCCCA |
| 3736 | ZNF91 | 3857122 | CCTGATTACTTATCTGGAGCAAGGAAAAGAGCCCTGGAATATGAAGCAACATGAGATGGTGGATGAACCCAC |
| 3737 | ZNF91 | 3857123 | TCTCCGGAGGAGTGGCAATGTCTGGACACTGCACAGCAGA |
| 3738 | ZNF91 | 3857124 | CCGGAGTTTCCAGGTCTCGACTTCACTGCTC |
| 3739 | CXCL17 | 3863641 | TGTTTCCTTCAAATGGGGTCTGCCAATTCACAACCAGATGACCCATTTTACCCTATTCACTGCAGACTGAATCCAGATTCTACACATACTTATCCCCACCAAGACCCTCACTCTGTCTCCATTGGCCTACTTGTTCATC |
| 3740 | CXCL17 | 3863642 | GAGCGCCCACTCTTCCAATTAAACATTCTCAGCCAAGAAGACAGTGAGCACACCTACCAGACACTCTTCTTCTCCCACCTCACTCTCCCACTGTACCCACCCCTAAATCATTCCAGTGCTCTCAAAAAGCATGTTTTTCAAGATCATTTTGTTTGTTGCTCTCTCTAGTGTCTTCTTCTCTCGTCAGTCTTAGCCTGTGCCCTCCCCTTACCCAGGCTTAGGCTTAATTACCTGA |
| 3741 | CXCL17 | 3863643 | AGCCAAACAAGCATTCCAGAGCCTGCCAGCAATTTCTCAAACAATGTCAGCTAAGAAGCTTTGCTCT |
| 3742 | CXCL17 | 3863644 | ATTGGTTCCTGAGAGCCCCGAGAAGAAAATTCATGACAGTGTCTGGGCTGCCAAAGAAGCAGTGCCCCTGTGA |
| 3743 | CXCL17 | 3863647 | GCCACAGGGACCGAGGCCAGGCTTCTAGGAGATGGCTCCAGGAAGGCGGCCAAGAAT |
| 3744 | CXCL17 | 3863648 | CCTGTTGCTGCCACTAATGCTGATGTCCATGGTCTC |
| 3745 | CXCL17 | 3863649 | CCCTCAAATGGGAACGCTGGCCTGGGACTAAAGCATAGACCACCAGGCTGAGTATCCTGACCTGAGTCATCCCCAGGGATCAGGAGCCTCCAGCAGGGAACCTTCCATTATATTCTTCAAGCAACTTACAGCTGCACCGACAGTTGCG |
| 3746 | TPX2 | 3881448 | TCCTCCCGGAGTTTGGAACGGCTGAAGTTCACCTTCCAGCCCCTAGCGCCGTTCGCGCCGCTAGGCCTGGCTTCTGAGGCGGTTGCGGTGCTCGGTCGCCGCCTAGGCGGGGCAGGGTGCGAGCAGGGGCTTCGGGCCACGCTTCTCTTGGCGACAGGATTTTGCTGTGAAGTCCGTCCGGGAAACGGAGGAAAAAAAGAGTTGCGGGAGGCTGTCGGCTAATAAC |
| 3747 | TPX2 | 3881451 | TGATACATATTTGCCAGACTTCAAGATTTCAGAAAAGGGGTGAAAGAGAAGATTGCAACTTTGAGTCAGACCTGTAGGCCTGATAGACTGATTAAACC |
| 3748 | TPX2 | 3881454 | AAGGTGACCTGCTGAGAAAAGTGGTACAAATACTGGGAAAAACCTGCTCTTCTGC |
| 3749 | TPX2 | 3881455 | CACAAGTTAAAAGCTCTTATTCCTATGATGCCCCCTCGGATTTCATCAATTTTTCATCCTTGGATGATGAAGGAGATACTCAAAACATAGATT |
| 3750 | TPX2 | 3881457 | GGAACTGGAGGGCTTTTTCAGGGCAAAACTCCTTTGAGAAAGGCTAATCTTCAGCAAGCTATTGTCACACCTTTGAAAC |

TABLE 13-continued

Subtyping Target Sequences

| SEQ ID NO. | Gene | Affy Probeset ID | Sequence |
|---|---|---|---|
| 3751 | TPX2 | 3881458 | GACAACACTTACTACAAAGAGGCAGAAAAAGAAAATCTTGTGGAACAATCCATTCCGTCAAA TGCCTTGTTCTTCCCTGGAAGTTGAGGCAGCCATATCAAGAAAA |
| 3752 | TPX2 | 3881459 | CAAGAGATGTGCCACTCCTGTAATCATCGATGAAAT |
| 3753 | TPX2 | 3881462 | AGAAGGCAGTGCTCATCAAGATACTGCTGAAAAGAATGCATCTTCCCCAGAGAAAGCCAAGG GTAGACATACTGTGCCTTGTATGCCACCTG |
| 3754 | TPX2 | 3881463 | GAGAAGAGTATGAAAATGCAGCAAGAGGTGG |
| 3755 | TPX2 | 3881464 | ATCAGTGAGCCAGGTCACCAAATCAGTTGACTTCCACTTCCGCACAGATGAGCGAATCAAACA ACATCCTAAGAACCAGGAGGAATATAAGGAAGTGAACTTTACATCTGAACTACGAAAGCATC CTTC |
| 3756 | TPX2 | 3881467 | GCCCGAGTGACTAAGGGATGTACCATTGTTAAGCCTTTCAACCTGTCCCAAGGAAAGAAAAG AACATTTGATGAAACAGTTTCTACATATGTGCCCCTTGCACAGCAAGTTGAAGACTTCC |
| 3757 | TPX2 | 3881468 | ATGGCTCACTTCAGTGTCCAACTCCTGGGCT |
| 3758 | TPX2 | 3881472 | CTTGATCCCAGAATACTTGAAGGTGGGCCCATCTTGCCCAAGAAACCACCTGTGAAACCACCC ACCGAGCCTATTGGCTTTGATTTGGAAATTGAGAAAAGAATCCAGGAGCGAGAATCAAAGAA GAAAACAGAGGATGAACACTTTGAATTTCATTCCAGACCTTGCCCTACTAAGATTTTG |
| 3759 | TPX2 | 3881476 | TGTTCCTGAAAAGAAGGTACTTCCAATCACC |
| 3760 | TPX2 | 3881477 | CATTGAAGAACAGAATTCGAATGCCCACCAAAGA |
| 3761 | TPX2 | 3881478 | GACGAACCGGTAGTGATAAAAGCTCAACCTGTGCCACATTATGGGGTGCCTTTTAAGCCCCAA ATCCCAGAGGCAAGAACTGTGGAAATATGCCCTTTCTCGTTTGATTCTCGAGACAAAGAACGT CAGTTA |
| 3762 | TPX2 | 3881479 | GTGCCCAAGTTCAAGGCACTTCCCTTGCCTCATTTTGACACCATTAACCTGCCAGAGAAGAAG GTAAAGAATGTGACCCAGATTGAACCTTTCTGCTTGGAGACTGACAG |
| 3763 | TPX2 | 3881482 | CTTGTTTCAAGGCTCGTCCAAACACCGTCATCTCTCAGGAG |
| 3764 | TPX2 | 3881483 | TTCAGGAACCTTTTCAGCTGGCTACTGAGAAGAGAGCCAAAGAGCGGCAGGAGCTGGAGAA GAGAATGGCTGAGGTAGAAGCCCAGAAAGCCCAGCAGTTGGAGGAGGCCAGACTACAGGA GGAAGAG |
| 3765 | TPX2 | 3881487 | GTGCATAAGGCAAATCCAATACGCAAGTACCAGGGTCTGGAGATAAAGTCAAGTGACCAGCC TCTGACTGTG |
| 3766 | TPX2 | 3881488 | CCAAATTCTCCACTCGATTCCACTGCTAA |
| 3767 | TPX2 | 3881489 | TCAGCTGTGAGCTGCGGATACCGCCCGGCAATGGGACCTGCTCTTAACCTCAAACCTAGGACC GTCTTGCTTTGTCATTGGGCATGGAGAGAACCCATTTCTCCAGACTTTTACCTACCCGTGCCTG AGA |
| 3768 | TPX2 | 3881490 | CAGAAAATAAAGATAGTTAAATCCT |
| 3769 | TPX2 | 3881491 | GTCCTCTTCTCTGCATACCGTGAATTTATAGTTAAGGATCCCTTTGCTGTGAGGGTAGAAAACC TCACCAACTGCACCAGTGAGGAAGAAGACTGCGTGGATTCATGGGGAGCCTCACAGCAGCCA CGCAGCAGGCTCTGGGTGGGGCTGCCGTTAAGGCACGTTCTTTC |
| 3770 | TPX2 | 3881492 | GGAACCGTGCAGTGTGCATTTTAAGACC |
| 3771 | TPX2 | 3881493 | TGGCCTGGAATAAATACGTTTTGTC |
| 3772 | MYL9 | 3883925 | GGAAGCCCCACCCACCAGAAGCCAAG |
| 3773 | MYL9 | 3883926 | GACCACCAAGAAGCGGCCACAGCGGGCCACATCCAATGTCTTCGCAATGTTTGACCAGTCCCA GATCCAGGAGTTTAAGGAGGCTTTCAACATGATTGACCAGAACCGTGATGGCTTCATTGACA AGGAGGACCTGCACGACATGCTGG |
| 3774 | MYL9 | 3883929 | AGAACCCCACAGACGAATACCTGGAGGGCATGATGAGCGAGGCCCCGGGGCCCATCAACTTC ACCATGTTCCTCACCATGTTTGGGGAGAAGCTGAACGGCACGGACCCCGAGGATGTGATTCG CAACGCCTTTGCCTGCTTCGACGAGGAAGCCTCA |
| 3775 | MYL9 | 3883930 | AGGAAGTGGACGAGATGTACCGGGAGGCACCCATTGATAAGAAAGGCAACTTCAACTACGT GGAGTTCACCCGCATCCCTCAAACATGGCGCCAAGGATAAAGACGACTAG |

TABLE 13-continued

Subtyping Target Sequences

| SEQ ID NO. | Gene | Affy Probeset ID | Sequence |
|---|---|---|---|
| 3776 | MYL9 | 3883931 | CACCCGTCCATACCAGCTCCCTGCCCATGACCCTCGCTCAGGGATCCCCCTTTGAGGGGTTAG<br>GGTCCCAGTTCCCAGTGGAAGAAACAGGCCAGGAGAAGTGCGTGCCGAGCTGAGGCAGATG<br>TTCCCACAGTGACCCCAGAGCCCTGGGCTATAGTCTCTGACCCCTCCAAGGAAAGACCACCTT<br>CTGGGGACATGGGCTGGAGGGCAGGACCTAGAGGCACCAAGGGAAGGCCCCATTCCGGGG<br>CTGTTCCCCGAGGAGGAAGGGAAGGGGCTCTGTGTGCCCCCCAGGAGGAAGAGGCCCTGAG<br>TCCTGGGATCAGACACCCCTTCACGTGTATCCCCACACAAATGCAAGCTCACCAAGGTCCCCT<br>CTCAGTCCCCTTCCCTACACCCTGACCGGCCACTGCCGCACACCCACCCAGAGCACGCCACCC<br>GCCATGGGAGTGTGCT |
| 3777 | MYL9 | 3883932 | GGACATCTGTCCCAGAGGGGGCAGAATCTCCAAT |
| 3778 | MYL9 | 3883934 | AGCTCGGCTGAAACTCCTCATCCTGGCTCCAAACAGAGGCCCAAAAGTCCCTGGTATCAACTC<br>CAGAAGGGGCGAGACCCGAACAAGTTCCAAACCAGGCCCAAATAGTATCCCAAACTCAGTCC<br>CAAACACATTCTCACCCCCGGCAGCAGGCTGCAGGCCTCCAGCTACACACACGGCCCTGGGC<br>AACTCTCAGTCTGGCCACCCATTCGATGCTGCCAGCCCCAAGGGTGTGGGAGGGGGGTCTCA<br>GAGTGTCCCAGGGTACTGGCCACACATGCCCGACACCAGGGTCATAAGGTCCTCTCAGCA |
| 3779 | FLRT3 | 3898359 | TGCCACTGTCCTGATACTTTTTAAGGTGGTCTTTGAAAAACTGTTTTTTTAAAATAGCCTTTTAG<br>TAGAGTGAGTTGGCATTTGTGATACTGTGAAATACACACTTTCTCTTTGTCCCTGTTTCTGGCA<br>TACAACTCCTAAAATCCTTGCAATCTTCAAAGTGATATATTTTCATATGCTAATGAGTTCACTG<br>ATAGCTGGCAGGCCCTAGGTAGCTTCAAGATAAAGTCTGATCATTGAAAAGACCAAGACATG<br>ATTATAGGGTTGGGACTTACAACCCCAAACCCTAACCTCCAGAGAGGGCGAAGTGGATGAAG<br>ATTAAGTTGATCACCAGTGACCAGTGGTTTAATCAAGCATGCCTATGTAATCAAGCCTCCATA<br>AAAAAACAAAAGGTCAAGATTTGGAGAGCTTCCAGATTGCTGAACATGTGGTGGTTCCTGCA<br>GGATGGCATGCCTGGAGAGGGCATGGAAGCTCTGTGCCCACCTAGACCTCACCTTATGTTTCC<br>TGCCATCTGGATCCTTTGTAACATCCTTTATAATACGTCAGTAAATCTGTTTCCTTGCATTTTGT<br>GAGCTGTTGTAGCAAATTAATAGAACACAAAAAGGGGATCCTGGGAAACCAAACTTGAAGCT<br>GACTAGTCTTGCAACTGGTGTC |
| 3780 | FLRT3 | 3898360 | TGCTTGCTTTTTCAGGATTGTGTTACTATCACTAAGTAGCAAATTGCCCAGCACATTAGTCCTA<br>AACGTCCCATGTATT |
| 3781 | FLRT3 | 3898361 | TGCTGTGTCGAACAATCAGGACTGCATTCATATGAGATCCTTGTAGTATAAGCACAGGCCATT<br>TTTCACTTTGGTATTAATAAAATGTAAAAAAAAAAAACTGGCTGAATGGCTGAATGAGATAAA<br>ATTTAATTTTAAAAAATGGTTATGAAATAATGTTCCAATTATTAAATTTGTATTATCCCAGTGGT<br>ATTCAATAAATCAAAATGTGTGAAGTAATGGGCAATATCAAACTTCCTGCATATCTCCATTTTT<br>GCTCTAGGCAAATTAATTATCCTTAAAAAAGTTAAGCATATCTTCTGAACTGAATACATCAGCT<br>GGCATAAAAGGAGCATGAAGTCTGTTAAAGCCATTGTCAGCAAAGCTTTGAAAATAAAGGAC<br>TTCACAAAAACGGTAATGTAAATGTGCTTCCAAGTTGGGGGGAAAATGTGTACTTAGGAAAA<br>CATGGAAACTTAGACTTGTATAGTGTAATGAACACAAATACCAAAACTGCATTTTGGTTTTGC<br>CTATACCATCCTGATTTTTGAAAAGTGAATTATAAACACAAAATTGTTAGTGTTTATGATGTTT<br>TTATCATAAAGGATGTCAGAGAAACTTTATGCATATTAAAAATGTAATGTAATTATAAGCGAT<br>TCCCCTCAACAATCCAGAGAAAGTAGTTCTTTAAATAAGAGATAATTTAAAGAAAAATAAATA<br>CTAGACATCAAATTTAGATCTGGTTTATGTCAAAGGTTTTAACACTGTACATAAATGTTCAATT<br>TACTTTTACAAAGATCAAGAATACTGCCCATTACTGTCACAATTTTCCAGATATTATATAATGA<br>ACTCGTAATGTAACATTTCCTTCTAGCTTCCTACTGAATTGTGAGCTGTTACTTGTTGAAAAAC<br>CATATCACTTTTCTGTTGCCATGATTTTTTTTTTTCAACAAAAAACCAAAGTGCATTGTACGCC<br>CTTTGGCCAGTCTTGTATGTGCCTTGATCAACGCTACATGTATT |
| 3782 | FLRT3 | 3898362 | CCTCATCGGGACTAAAATTGGGCTGTTCCTTCAAGTAGCACCTCTATCAGTTATGGCTAAATCC<br>TGTCCATCTGTGTGTCGCTGCGATGCGGGTTTCATTTACTGTAATGATCGCTTTCTGACATCCA<br>TTCCAACAGGAATACCAGAGGATGCTACAACTCTCTACCTTCAGAACAACCAAATAAATAATG<br>CTGGGATTCCTTCAGATTTGAAAAACTTGCTGAAAGTAGAAAGAATATACCTATACCACAACA<br>GTTTAGATGAATTTCCTACCAACCTCCCAAAGTATGTAAAAGAGTTACATTTGCAAGAAAATA<br>ACATAAGGACTATCACTTATGATTCACTTTCAAAAATTCCCTATCTGGAAGAATTACATTTAGA<br>TGACAACTCTGTCTCTGCAGTTAGCATAGAAGAGGGAGCATTCCGAGACAGCAACTATCTCCG<br>ACTGCTTTTCCTGTCCCGTAATCACCTTAGCACAATTCCCTGGGGTTTGCCCAGGACTATAGAA<br>GAACTACGCTTGGATGATAATCGCATATCCACTATTTCATCACCATCTCTTCAAGGTCTCACTA<br>GTCTAAAACGCCTGGTTCTAGATGGAAACCTGTTGAACAATCATGGTTTAGGTGACAAAGTTT<br>TCTTCAACCTAGTTAATTTGACAGAGCTGTCCCTGGTGCGGAATTCCCTGACTGCTGCACCAGT<br>AAACCTTCCAGGCACAAACCTGAGGAAGCTTTATCTTCAAGATAACCACATCAATCGGGTGCC<br>CCCAAATGCTTTTTCTTATCTAAGGCAGCTCTATCGACTGGATATGTCCAATAATAACCTAAGT<br>AATTTACCTCAGGGTATCTTTGATGATTTGGACAATATAACACAACTGATTCTTCGCAACAATC<br>CCTGGTATTGCGGGTGCAAGATGAAATGGGTACGTGACTGGTTACAATCACTACCTGTGAAG<br>GTCAACGTGCGTGGGCTCATGTGCCAAGCCCCAGAAAAGGTTCGTGGGATGGCTATTAAGGA<br>TCTCAATGCAGAACTGTTTGATTGTAAGGACAGTGGGATTGTAAGCACCATTCAGATAACCAC<br>TGCAATACCCAACACAGTGTATCCTGCCCAAGGACAGTGGCCAGCTCCAGTGACCAAACAGC<br>CAGATATTAAGAACCCCAAGCTCACTAAGGATCACCAAACCACAGGGAGTCCCTCAAGAAAA<br>ACAATTACAATTACTGTGAAGTCTGTCACCTCTGATACCATTCATATCTCTTGGAAACTTGCTCT<br>ACCTATGACTGCTTTGAGACTCAGCTGGCTTAAACTGGGCATAGCCCGGCATTTGGATCTAT<br>AACAGAAACAATTGTAACAGGGGAACGCAGTGAGTACTTGGTCACAGCCCTGGAGCCTGATT<br>CACCCTATA |

TABLE 13-continued

Subtyping Target Sequences

| SEQ ID NO. | Gene | Affy Probeset ID | Sequence |
|---|---|---|---|
| 3783 | FLRT3 | 3898363 | TCTGAAGTAACGGAAGCTACCTTGTATAAAGACCTCA |
| 3784 | FLRT3 | 3898365 | TACCTGTTCTTGTATAACGTGACTGCACCAGACATTCTGAAAA |
| 3785 | FLRT3 | 3898369 | CTTTGTGTGGACTGGACGCAGAGCTTGGGAGACGGGGAGGGCTATTACTCCAATTCACTGT<br>CAATGGAATTACAGCTATAGCGGCAGTGTATATAGGATTGCTTTTTC |
| 3786 | TGM2 | 3905144 | TTACTTCCACGTTGGCCTATCTGTCCCCTTCTCCATCCTATCTGAAGCCCTCGAGGCAGGGACC<br>ACGTATCTCTTAAATACACTAATAAATGCTGAATTGGTAAATGAATGTTTCCTAACTCAACTCC<br>CACAAGACCTGTGCTGTCCCATAGAAATAATACATGAGCCACAAATGCAAGCCACATATGTAA<br>TTTAGAATTTTCTAGTGACCACATTGAAAACAGTAAAAAAGCCATAGGTGGAATTAGCTTTAA<br>TAATGTATTTTATTTAATCCAATATATCCAAAACATTATTTCAACATGTAATCAATATAAGAATT<br>AGTAAGGTATTTGACCTTCTTATTTTTGTACTCAATCTTTGAAATGTGGTGTGTGTTTTATACTG<br>ACAGCAGGTCTCAATTTGAACTAGCTGCATTTCAAGTGCTCGGTAGCCAGTCTGGCTAGTACT<br>GGATGAAGCAGGTCTAGACTGCGATTCCGTGGATGTG |
| 3787 | TGM2 | 3905146 | CCCAGCCTGACCTGAGACTGTCGGAGAGGCTGTCTGGGGCCTTTATCAAAAAAAGACTCAGC<br>CAAGACAAGGAGGTAGAGAGGGGACTGGGGGACTGGGAGTCAGAGCCCTGGCTGGGTTCA<br>GGTCCCACGTCTGGCCAGGCACTGCCTTCTCCTCTCTGGGCCTTTGTTTCCTTGTTGGTCAGAG<br>GAGTGATTGAACCAGCTCATCTCCAAGGATCCTCTCCACTCCATGTTTGCAATGCTTTTATATG<br>GCCCAGCCTTGTAAATAACCACAAGGTCCACTCCCTGCTCCACGAAGCCTTAAGCCATAGGCC<br>CAGGATATTTCTGAGAGTGAAACCATGACTGTGACCACCTTCTGTCCCCAGCCCTGTCCTGGTT<br>CCTTCCTATGCCCAGGTACCACCCTTCAGACCCCAGTTCTAGGGGAGAAGAGCCCTGGACACC<br>CCTGCTCTACCCATGAGCCTGCCCGCTGCAATGCCTAGACTTCCCAACAGCCTTAGCTGCCAGT<br>GCTGGTCACTAACCAACAAGGTTGGCACCCCAGCTACCCCTTCTTTGCAGGGCTAAGGCCCCC<br>AAACATAGCCCCTGCCCCGGAGGAAGCTTGGGGAACCCATGAGTTGTCAGCTTTGACTTTATC<br>TCCTGCTCTTTCTACATGACTGGGCCTCCCTTGGGCTGGAAGAATTGGGGATTCTCTATTGGA<br>GGTGAGATCACAGCCTCCAGGGCCCCCAAATCCCAGGGAAGGACTTGGAGAGAATCATGCT<br>GTTGCATTTAGAACTTTCTGCTTTGCACAGGAAAGAGTCACACAATTAATCAACATGTATATTT<br>TCTCTATACATAGAGCTCTATTTCTCTACGGTTTTATAAAAGCCTTGGGTTCCAACCAGGCAGT<br>AGATGTGCTTC |
| 3788 | TGM2 | 3905147 | CATTTAATCACCATGGGAAACTGTTGTGGGCGCTGCTTCCAGGATAAGGAGACTGAGGCTTA<br>GAGAGAGGAGGCAGCCCCCTCCACACCAGTGGCCTCGTGGTTATTAGCAAGGCTGGGTAATG<br>TGAAG |
| 3789 | TGM2 | 3905148 | GTCCCCTCCACATCCCAGCAGCCCAAG |
| 3790 | TGM2 | 3905149 | CCAAGCTAGTGAGCAAAATATGCCCCTTCTTGGGCCCCAGACCCCAGGGCAGGGTGGGCAGC<br>CTATGGGGGCTCTCGGAAATGGAATGTGCCCCTGGCCATCTCAGCCTCCTGAGCCTGTGGGT<br>CCCCACTCACCCCCTTTGCTGTGAGGAATGCTCTGTGCCAGAAACAGTGGGAGCCCTGACCTT<br>GGCTGACTGGGGCTGGGGTGAGAGAGGAAAGACCTACATTCCCTCTCCTGCCCAGATGCCCT<br>TTGGAAAGCCATTGACCACCCACCATATTGTTTGATCTACTTCATAGCTCCTTGGAGC |
| 3791 | TGM2 | 3905150 | TGCCGCTCCACATGGGCCTCCACAAGCTGGTGGTGAACTTCGAGAGCGACAAGCTGAAGGCT<br>GTGAAGGGCTTCCGGAATGTCATCATTGGCCC |
| 3792 | TGM2 | 3905151 | AAGGCTGCACCTTCACTGTGGAGGGGGCCGGCCTGACTGAGGAGCAG |
| 3793 | TGM2 | 3905152 | TCCTCTATGAGAAATACCGTGACTGCCTTACGGAGTCCAACCTCATCAAGGTGCGGGCCCTCC<br>TCGTGGAGCCAGTTATCAACAGCTACCTG |
| 3794 | TGM2 | 3905153 | TGGGGCTAAGAACCACACTTCAGTGGGTAGCTTTGTTCCTGCCATCTTCTTTCTCATCCCCATA<br>TCACTGTGCGGCTTTTGCTCTGCAACGACCCCTTGGTCTTACCTCTGCCCAGCAGGTGATAAGAT<br>CTGGGAACAGAGAGGAAACAGAGGGGAAACAGAGAGGGGAGGTCATCTCCCCGGGCTCAC<br>ACAGCCAGTGAGTGGCCAGACAGGGCCTGAGGCAAGTCTCCCAATCTGAGCACTTACTGGCA<br>GAGGTGATTCTTCATCTGTGCAACGGGTACAGCATCACGAGCCTCGTGGAGGGAAATGACCT<br>TATGTCCATGAGAGGCATTCTTCAGTGAGTGTGGACCATATTGTTGGACTCTAAGATCTGGAT<br>TATTAGTCCAGATGCCTGCACAGTACATATCAGCTGTGTGACCTAGGACAACGTTATTTCACCT<br>GCTGGAGACTCAGTTTTCTCATCTGTAAGTTGGGTGGTAATACACGTACAAGCCTTTTAGGGT<br>TGTCATGTAGGTGAAGTAGGAGCCCGCCGTGGGAAGTGCAGTGCCTGGTGCAGCAAGCAGA<br>TGTCGGCTCTGATCCTCCCCAGGATGAAGGGCCCGCGGCTCACACACCCTGAGTCCCGAGCG<br>CACCAGGCTCTTCCGGGACACTCGCTCAGCTCATCCTCCCACAGCCTTAGGAGTGCCTGTGCC<br>ACGCAGATCCAAACATCGAGGACCTGGAGGTGGAGTGGCTCACGCGGGTCACCCATTAG<br>AAGAGGCAAAGGCAGGATTAGAACCAAGGCCCGTGGGAGTCCAAGTGCGTCCTCTACC |
| 3795 | TGM2 | 3905161 | GTAAAGCCCTGTGTTCCTGGAGCATTTGTTGA |
| 3796 | TGM2 | 3905162 | GGGCGAACCACCTGAACAAACTGGCCGAGAAGGAGGAGACAGGGATGGCCATGCGGATCC<br>GTGTGGGCCAGAGCATGAACATGGGCAGTGACTTTGACGTCTTTGCCCACATCACCAACAAC<br>ACCGCTGAGGAGTACGTCTGCCGCCTCCTGCTCTGTGCCCGCACCGTCAGCTACAATGGGATC |

TABLE 13-continued

Subtyping Target Sequences

| SEQ ID NO. | Gene | Affy Probeset ID | Sequence |
|---|---|---|---|
| 3797 | TGM2 | 3905165 | GCCCAGTTCCAGTTCGTGCCATCAAGGAGGGCGACCTGAGCACCAAGTACGATGCGCCCTTT GTCTTTGCGGAGGTCAATGCCGACGTGGTAGACTGGATCCAGCAGGACGATGGGTCTGTGCA CAAATCCATCAACCGTTCCCTGATCGTTGGGCTGAA |
| 3798 | TGM2 | 3905167 | ACTTCCACTGCTGGGTGGAGTCGTGGATGACCAGGCCGGACCTGCAGCCGGGGTACGAGGG CTGGCAGGCCCTGGA |
| 3799 | TGM2 | 3905168 | CGCGTCGTGACCAACTACAACTCGGCCCATGACCAGAACAGCAACCTTCTCATCGAGTACTTC CGCAATGAGTTTGGGGAGATC |
| 3800 | TGM2 | 3905171 | TCAGCACAGAACCTAGCCCAGTGTCACTCTCGGCAAATATTAGCCAGTAATAACTGGATCCTA ACAGTAATATCAGTGTCAAGAAAGAAAGCATGTTCTAAAATGTAGAGGGGGAATATCGAGCA ATTTAAAACCAAAAAGTAAATAAATCTAAAACAAAATCTTCAAAATTTAAGGCCAGAAAA TGTCGATGATTGTTGCCAGGCTGATGATGGTGCTTATGAGAATGGGTTAGCATCACATGCTG GCTAAGAACGTAGACTCA |
| 3801 | TGM2 | 3905172 | CTGCACGCTGGGATGTGGGTCATGAGCCCTGGGAGGGGGCACGAAGAGCACTGGAGTAGG AATCAGGACATCCCTGCCCTGGTCCTGCCCCCTGCCACCAACACTCTCAATGCGCTATGTGGCC TAGAGCCTGTGACCACCCTCTCCGGTCCTTTATCCAATAGCCATCCCTCCAGTGG |
| 3802 | TGM2 | 3905173 | CGCTGGGACAACAACTACGGGGACGGCGTCAGCCCCATGTCCTGGATCGGCAGCGTGGACA TCCTGCGGCGCTGGAAGAACCACGGCTGCCAGCGCGTCAAGTATGGCCAGTGCTG |
| 3803 | TGM2 | 3905175 | AGATGGGATCCTAGACATCTGCCTGATCCTTCTAGATGTCAACCCCAAGTTCCTGAAGAACGC CGGCCGTGACTGCTCC |
| 3804 | TGM2 | 3905177 | TGCTGTGTACCTGGACTCGGAAGAGGAGCGGCAGGAGTATGTCCTCACCCAGCAGGGCTTTA TCTACCAGGGCTCGGCCAAGTTC |
| 3805 | TGM2 | 3905179 | TGACTGGACAGCCACCGTGGTGGACCAGCAAGACTGCACCCTCTCGCTGCAGCTCACCACCCC GGCCAACGCCCCCATCGGCCTGTATCGCCTCAGCCTGGAGGCCTCCACTGGCTACCAGGGATC CAGCTTTGTGCTGGGCCACTTCATTTTGCTCTTCAACGCCTGGTGCC |
| 3806 | TGM2 | 3905180 | CAAGGCCCGTTTTCCACTAAGAGATGC |
| 3807 | TGM2 | 3905184 | CTGGAGACCAATGGCCGAGACCACCACACGGCCGACCTGTGCCGGGAGAAGCTGGTGGTGC GACGGGGCCAGCCCTTCTGGCTGACCCTGCACTTTGAGGGCCGCAACTACGAGGCC |
| 3808 | TGM2 | 3905187 | CAGCCGCCAGTGGTCGCACTTGGAGGGTCTCGCCGCCAGTG |
| 3809 | TGM2 | 3905188 | GTTAGCGCCGCTCTCCGCCTCGGCAG |
| 3810 | TGM2 | 3905190 | CAAGAGACCAGAGATACCAGGATGAGAGATAGGACCCCTGGTTGCCAGGTTCGAGAAGTCC TAGGCTGAGTCCCTG |
| 3811 | TMPRSS2 | 3933041 | GCTTTGACAAAATGACTGGCTCCTGACTTAACGTTCTATAAATGAATGTGCTGAAGCAAAGTG CCCATGGTGGCGGCGAAGAAGAGAAAGATGTGTTTTGTTTTGGACTCTCTGTGGTCCCTTCCA ATGCTGTGGGTTTCCAACCAGGGGAAGGGTCCCTTTTGCATTGCCAAGTGCCATAACCATGAG CACTACTCTACCATGGTTCTG |
| 3812 | TMPRSS2 | 3933042 | CTGGTTTTGCTTCCCCGTGCATGATTTACTCTTAGAGATGATTCAGAGGTCACTTCATTTTTATT AAACAGTGAACTTGTCTGGC |
| 3813 | TMPRSS2 | 3933045 | CCTCTGGTCACTTCGAAGAACAATATCTGGTGGCTGATAGGGGATACAAGCTGGGGTTCTGG CTGTGCCAAAGCTTACAGACCAGGAGTGTACGGGAATGTGATGGTATTCACGGACTGGATTT ATCGACAAATG |
| 3814 | TMPRSS2 | 3933046 | GGTGGAGATTCGAAGCCCACACAGTCACTCGTAACTCACACTGCGACCCCCGCCCCCAACTC CTCTAGGCCTGGTCAGTGGTGTGCGGCAGATTGTGACTTGATTTTCTGCTCTCTGTACCTTGCT GTGTCCCACAG |
| 3815 | TMPRSS2 | 3933047 | TCAGAAGTGCTGAACGCTGCCAAGGTGCTTCTCATTGAGACACAGAGATGCAACAGCAGATA TGTCTATGACAACCTGATCACACCAGCCATGATCTGTGCCGGCTTCCTGCAGGGGAACGTCGA TTCTTGCC |
| 3816 | TMPRSS2 | 3933048 | TAGAGCCCTATAGTTTCAGAGCTGGGAATTTCTTTCCCTGAAGCTGAACTCCAGAGCTGCATT CAGCACAGGCACCGCCAGTTGTAAGGAGAATCCAGGTTTCCCAGGAGAGGGTTGGTGCTG GGATGAGCTGACCGGGCAGGGCTGGAAAATAGGGCTGTGACCATCTGTGTAGTGCGTGTG GAGGTCTCAGGGAGGGAAGTGTGCTCTCCCTGCGAGAGCTGCAGGCAACACTGGGAGCTCA ACA |
| 3817 | TMPRSS2 | 3933052 | AAACCAGTGTGTCTGCCCAACCCAGGCATGATGCTGCAGCCAGAACAGCTCTGCTGGATTTCC GGGTGGGGGGC |

TABLE 13-continued

Subtyping Target Sequences

| SEQ ID NO. | Gene | Affy Probeset ID | Sequence |
| --- | --- | --- | --- |
| 3818 | TMPRSS2 | 3933053 | AATCCATGGCATTGGACGGCATTTGCGGGGATTTTGAGACAATCTTTCATGTTCTATGGAGCCGGATACCAAGTAGAAAAGTGA |
| 3819 | TMPRSS2 | 3933056 | TGGCAGGTCAGCCTGCACGTCCAGAACGTCCACGTGTGCGGAGGCTCCATCATCACCCCCGAGTGGATCGTGACAGCCGCCCAC |
| 3820 | TMPRSS2 | 3933060 | AAAGCAGTGGTTTCTTTACGCTGTATAG |
| 3821 | TMPRSS2 | 3933061 | CCAAGGAATAGTGGATGACAGCGGATCCACCAGCTTTATGAAACTGAACACAAGTGCCGGCAATGTCGATATCTATAAAAAACTGTACCAC |
| 3822 | TMPRSS2 | 3933062 | AGGTGTACTCATCTCAGAGGAAGTCCTGGCACCCTGTGTGCCAAGACGACTGGAACGAGAACTACGGGCGGGCGGCCTGCAGGGACATGGGCTATAA |
| 3823 | TMPRSS2 | 3933070 | ATGGGCCTTACCTCATATACGTGTCTTATTAAGAACACATAAAACCTACTCTTGTAGTGATTTTCAAATATGCAACATATAGTTTATTAACTGCAGTCACTATGATGTACAATAGATTGCTCGAACTTATTCCTCCTGTCTAACTAAGATTTTGTGACCTCTGACCAACATCTCCCCAGTGTTGTCACCCCCCGCCCCCAGCCTCTGATAGCTGCCTTTCTACTCTCTGCTTCTGTGAGTTTGATGTTTATACATTCCACATGTAAGTGGCCTCATGCAGTGTTTCTGTCTCTGGCTTGTTCACTTAGCGTAATGTCCTCCAGCTTCATCTATGTTGTTGGAAATGACAGGATTTCCTTCTTTCTTGTGGCTGAATAGTATTGCCTTGTGCATATACACCACATTTTCTTTATCCCTTCATTCACTGATGGACTCTTAGGTTGATGTCATGTCTTGGCTGTTGTGAAAAATGCCGCAGTGAGCGTGGGCGTGCAGGTCCCTCTTCAACACACGGATTTCCTTTCCTTTGGATATAAACCCAGCAGTGAGATTGCTGGATCACATGGCAGTTCTGTTTCTCACCTTTTGAGGAAACTCCATACTGTTTTCCATAATGGCTGTAGCAACTTCCACTCCCACCCCCACGGTGCAAAGTCTCCATTTCTCTTCTACAACCTCACCAACTCCTGTTATTTTCCATCTTTCTGATAGTAGCCATTTGAAGAGGTATGAGATGATACCTCATTGTGGTTTTCATTTGCATTTTTATTTGTATTTTTCATGAATTTTTGAGGGTGATTTCAAGGGTAGTAGTGACTCGAACAGGGAAACGATCCTGAGTATGAGGGTTGTGCTAATCATCCCCCTCCTGCCAGCTGCGTACGGAATG |
| 3824 | TMPRSS2 | 3933071 | TGCATCAACCCCTCTAACTGGTGTGATGGCGTGTCACACTGCCC |
| 3825 | TMPRSS2 | 3933072 | CTCCAACTCTGGGATAGAGTGCGACTC |
| 3826 | TMPRSS2 | 3933074 | CTGCGCTGGCCGCTGGCCTACTCTGGAAGTTCA |
| 3827 | TMPRSS2 | 3933075 | TTGGACCTTACTATGAAAACCATGGATACCAACCGGAAAACCCCTATCCCGCACAGCCCACTGTGGTCCCCACTGTCTACGAGGTGCATCCGGCTCAGTACTACCCGTCCCCGTGCCCCAGTACGCCCCGAGGGTCCTGACGCAGGCTTCCAACCCCGTCGTCTGCACGCAGCCCAAATCCCCATCCGGGACAGTGTGCACCTCAA |
| 3828 | TMPRSS2 | 3933078 | CATTCCAGATACCTATCATTACTCGATGCTGTTGAT |
| 3829 | TMPRSS2 | 3933093 | CCGCCCGGAGGTGAAAGCGGGTGTGA |
| 3830 | TMPRSS2 | 3933099 | GTGACCCGTGCATCTTTCCAGCTTTTCCTTGGCCACCTGGGTGGCATGGGAGCTGGGAGTCAGAGTTCTGCTGAGCTGTAGGACCAAAGGCCACTGGCTCCGCTGCACCTGCGGACTGAGACACCCACCTGCTGAGTGAGACCCAGCCTCTGCGTGCTTAGGGGTCCCCTGCTACAGGGCATTGAGGTGAGGTCCGCCTTTGCCCAGTGTGAGAGCGCTGCTTTCAGAGCTTTGAGAAGGCTGTTATCATTTGTTTCTTTTTGAACTTGCCACCTCCCCACTTAGAGAATATTTCTGGGGACAGAGTTTCGTAACTCCTGCCGCATAGTTGGTGCCTGCTCTCGACTACATTAAA |
| 3831 | TMPRSS2 | 3933101 | CAAGTGGGGTCTGGACCACCGACCTTAGCTTCACCTCAACCCCCAAGAACACCTGCCCCGTTGGAG |
| 3832 | TIMP3 | 3943506 | GTCCCGCCGGGCACTCGGAGGGCAGCGCGCCGGAGGCCAAGGTTGCCCCGCACGGCCCGGCGGGCGAGCGAGCTCGGGCTGCAGCAGCCCCGCCGGCGGCGCGCACGGCAACTTTGGAGAGGCGAG |
| 3833 | TIMP3 | 3943507 | ATGACCCCTTGGCTCGGGCTCATCGTGCTCCTGGGCAGCT |
| 3834 | TIMP3 | 3943508 | GCGTGCACATGCTCGCCCAGCCACCCCC |
| 3835 | TIMP3 | 3943530 | ACTAGCCATCAGTGGAAGCGGGAAATAGGACTTCTATTTCTTGTTGTCACCCTCACCAGCACCCAACCCAATGTTCCAGACACCAACCTAGTTCATGCCTATGTTGGTTTGATTG |
| 3836 | TIMP3 | 3943531 | AGGTTCCAAGCTCAGGCTATTTGGG |
| 3837 | TIMP3 | 3943532 | CTCTTGTAAACACAATCATCTATTCCAGTTGGC |
| 3838 | TIMP3 | 3943533 | GGGGCCCTTCGGCACGCTGGTCTACACCATCAAGCAGATGAA |
| 3839 | TIMP3 | 3943534 | GCTTATCTGTCTAATACGGGCATGAGGGTGAGACCCCACAGGCCTGGAAACTCCCCAGAGGAGACAAGCCGCAATGTCCAGGTAGAAGGGAGTGGAGGAGTGACGCAGCCCACGGTGGTACCCAACCATCCCCAAGGCCAACCTCCAGGCTTTCTTATTCCTGTGTCCTGAGGCTGGATGTACTAAT |

TABLE 13-continued

Subtyping Target Sequences

| SEQ ID NO. | Gene | Affy Probeset ID | Sequence |
|---|---|---|---|
| | | | TTTGTGGAACCTGTTGCTTTGGATTCAATTTTGCAAACATCCACAGCCTTCTGGTTATGTAATG<br>TCCAGAGTCAGCCCTGGCCAGTTGCCCTTGGCTGCCTAAGCTTGGTCATG |
| 3840 | TIMP3 | 3943535 | CGGGACTCAGGTCCTAAGGTTGACAAAGAAAAAGGACCTTTGTCACAGCTACTTCTCTGGATT<br>TCTGAAAAGGTGCTGGGATGTCAGACATGTGTAGCCGAAGGAGTGTTGTGGGGCAGTTGGA<br>ATGGGGGGTATGGCTGGCTGCACAGGAAGGTTTCTCTGGGAAGGCACCAACCTGGCTAGTC<br>AAGAGGATCGGTGGCTTCATCTGGGGTGAAGGGGGCCCTGGGGTGGGTAGATCAGTGACCG<br>GCCACTGGACAGCTGAATAGGGGAGCGAGATTCCCTCAGATCCAATGTCAGC |
| 3841 | TIMP3 | 3943536 | CGCTTAGCAAAACGACCTCCAGTTCCAGCTGCATTGCCACAAATGACAAGATTTCATTCTTTTT<br>TCTGGATGAATCATATTCCATTGGGTATAGATACCAGGTTTTGTCTATCCATTCATCTGTTGAT<br>GGGCACTTAGGTTGATTTCATATCTTGGCTATTGTGAATATTGCTGCAGTCAACATGAGAGTG<br>CAGACCCCTCTTCCATATTCCGATTTCCTTTCCTTTGGATACATACCCAGCAGTGGGATTAGGG<br>ATCATACGGGTGTCCAAACTGG |
| 3842 | TIMP3 | 3943537 | CAAGATGCCCCATGTGCAGTACATCCATACGGAAGCTTCCGAGAGTCTCTGTGGCCTTAAGCT<br>GGAGGTCAACAAGTACCAGTACCTGC |
| 3843 | TIMP3 | 3943538 | GTCGCGTCTATGATGGCAAGATGTACACGGGGCTGTGCAACTTCGTGGAGAGGTGGGACCA<br>GCTCACCCTCTCCCAGCGCAAGGGGCTGAACTATCGGTATCACCTGGGTTGTAAC |
| 3844 | TIMP3 | 3943539 | CAGGTCTGAGCAGATATAGTAAGGATTGTTGCCCCAGGTGGGGCAGTGAGGAAGGCAGGGA<br>AGGAAGAATGCCTTTCTGCTGTAATCGGCTGCCTCCATGATGACCACTTGGAAGCTGCTGGG<br>GCATGAGGGCTCTTGAGTCCCTGGCCCCACCTGGCAGTTCAAGGCTGGAGG |
| 3845 | TIMP3 | 3943540 | TGTGACTTCCAAGAACGAGTGTCTCTGGACCGACATGCTCTCCAATTTCGGTTACCCTGGCTAC<br>CAGTCCAAACACTACGCCTGCATCCGGCAGAAGGGCGGCTACTGCAGCTGGTACCGAGGA |
| 3846 | TIMP3 | 3943541 | AAGGCCAACCATTTCAGGATCAGTCAAAGGCAGCAAGCAGATAGACTCAAGGTGTGTGAAA<br>GATGTTATACACCAGGAGCTGCCACTGCATGTCCCAACCAGACTGTGTCTGTCTGTGTCTGCA<br>TGTAAGAGTGAGGGAGGGAAGGAAGGAACTACAAGAGAGTCGGAGATGATGCAGCACACA<br>CACAATTCCCCAGCCCAGTGATGCTTGTGTTGACCAGATGTTCCTGAGTCTGGAGCAAGCACC<br>CAGGCCAGAATAACAGAGCTTTCTTAGTTGGTGAAGACTTAAACATCTGCCTGAGGTCAGGA<br>GGCAATTTGCCTGCCTTGTACAAAAGCTCAGGTGAAAGACTGAGATGAATGTCTTTCCTCTCC<br>CTGCCTCCCACCAGACTTCCTCCTGGAAAACGCTTTGGTAGATTTGGCCAGGAGCTTTCTTTTA<br>TGTAAATTGGATAAATACACACCATACACTATCCACAGATATAGCCAAGTAGATTTGGGTA<br>GAGGATACTATTTCCAGAATAGTGTTTAGCTCACCTAGGGGGATATGTTTGTATACACATTTG<br>CATATACCCACATGGGGACATAAGCTAATTT |
| 3847 | TIMP3 | 3943542 | CTCTTCCCTATCATGGGTCATCTGACCCCTGTCCGTCTCCTTGTCCCTGCTTCATGTTTGGGGGC<br>CTTTCTTTAACTGCCTTCCTGGCTTAGCTCAGATGGCAGATGAGAGTGTAGTCAAGGGCCTGG<br>GCACAGGAGGGAGAGCTGCAGAGTGTCCTGCCTGCCTTGGCTGGAGGGACACCTCTCCTGG<br>GTGTGGAGACAGCTTGGTTCCCTTTCCCTAGCTCCCTGGTGGGTGAATGCCACCTCCTGAGAT<br>CCTC |
| 3848 | TIMP3 | 3943543 | CGGCATCGGGTTTCCTTGGGATCAATTTCATTACCGTGTACCTTTCCCATTGTGGTCATGCCAT<br>TTGGCAGGGGGAGAATGGGAGGCTTGGCCTTCTTTGTGAGGCAGTGTGAGCAGAAGCTGAT<br>GCCAGCATGTCACTGGTTTTGAAGGGATGAGCCCAGACTTGATGTTTTGGGATTGTCCTTATT<br>TTAACCTCAAGGTCTCGCATGGTGGGGCCCCTGACCAACCTACACAAGTTCCCTCCCACAAGT<br>GGACATCAGTGTCTTCTCTGTGAGGCATCTGGCCATTCGCACTCCCTGGTGTGGTCAGCCTCT<br>CTCACACAAGGAGGAACTTGGGTGAAGGCTGAGTGTGAGGCACCTGAAGTTTCCCTGCGGA<br>GTCGATAAATTAGCAGAACCACATCCCCATCTGTTAGGCCTTGGTGAGGAGGCCCTGGGCAA<br>AGAAGGGTCTTTCGCAAAGCGATGTCAGAGGGCGGTTTTGAGCTTTCTATAAGCTATAGCTTT<br>GTTTATTTCACCCGTTCACTTACTGTATAATTTAAAATCATTTATGTAGCTGAGACACTTCTGTA<br>TTTCAATCATATCATGAACATTTTATTTTGCTAAATCTTGTGTCATGTGTAGGCTGTAATATGTG<br>TACATTGTGTTTAAGAGAAAAATGAAACCCACATGCCGCCATTTTCCTGAATCAAATTCTGCA<br>GTGGAATGGAGAGGAAAATACTTCTAGGCAAGCAGCTAGACTGGTGAATTGGGGGAAATAG<br>AAGGAACTAGTAACTGAGACTCCTCCAGCCTCCTCCCTATTGGAATCCCAATGGCTCCTGGAG<br>TAGGAAAAAGTTTAAACTACATTCATGTTCTTGTTCTGTGTCACTCGGCCCTGGGTAGTCTAC<br>CATTTACTTCACCCCAAGTCCTGCTGCCCATCCAGTTGGGAAGCCATGATTTTCCTAAGAATCC<br>AGGGCCATGGGAGATACAATTCCAAGTTCTCGCTTCCTCCTTTGGGCATCTCTTCTGCCTCCCA<br>ATCAAGGAAGCTCCATGCTCAGGCTCTCAGCTCTCGGGCCAGTGCTCTGCTCTGTCAGGGTA<br>GGTAATACTGGGAGACTCCTGTCTTTTACCCTCCCCTCGTTCCAGACCTGCCTCATGGTGGCAA<br>CATGGTTCTTGAACAATTAAAGAAACAAATGACTTTTTGGAATAGCCCTGTCTAGGGCAAACT<br>GTGGCCCCCAGGAGACACTACCCTTCCATGCCCCAGACCTCTGTCTTGCATGTGACAATTGAC<br>AATCTGGACTACCCCAAGATGGCACCCAAGTGTTTGGCTTCTGGCTACCTAAGGTTAACATGT<br>CACTAGAGTATTTTATGAGAGACAAACATTATAAAAATCTGATGGCAAAAGCAAAACAAAAT<br>GGAAAGTAGGGGAGGTGGATGTGACAACAACTTCCAAATTGGCTCTTTGGAGGCGAGAGGA<br>AGGGGAGAACTTGGAGAATAGTTTTTGCTTTGGGGGTAGAGGCTTCTTAGATTCTCCCAGCAT<br>CCGCCTTTCCCTTTAGCCAGTCTGCTGTCCTGTGAAACCCAGAAGTGATGGAGAGAAACCAACA<br>GAGATCTCGAACCCTGTCTAGAAGGAATG |
| 3849 | TIMP3 | 3943554 | TGGGAACAGATTTGCTGTCTGCAAAGGCTGCATCTGCGGGTCTGGCGTGCAAAGGAGGGTG<br>GTTCTTTGGCTAATGGTGGACTTGCTCCTAGGCCTATCCCAGAGTC |

TABLE 13-continued

Subtyping Target Sequences

| SEQ ID NO. | Gene | Affy Probeset ID | Sequence |
|---|---|---|---|
| 3850 | UPK3A | 3948530 | CCGCCCCGCGCTCTGGCGGCTCCTCCCGGGCG |
| 3851 | UPK3A | 3948532 | GCCAGTGTGACTTTCGCCACCAACAACCCCACACTTACCACTGTGGCCTTGGAAAAGCCTCTCT GCATGTTTGACAGCAAAGAGGCCCTCACTGGCACCCACGAGGTCTACCTGTATG |
| 3852 | UPK3A | 3948533 | CCAGGAATGCCTCAGTGCAAGACAGCACCAACACCCCACTGGGCTCAACGTTCCTACAAACA GAGGGTGGGAGGACAGGTCCCTACAAAGCTGTGGCCTTTGACCTGATCCCCTGCAGTGACCT GCCCAGCCTGGATGCCATTGGGGATGTGTCCAAGGCCTCACAGATCCTG |
| 3853 | UPK3A | 3948535 | TCCTGGTCAATATGTCCACGGGCTTGGTAGAGGACCAGACCCTGTGGTCAGACCCCATCCGCA CCAACCAG |
| 3854 | UPK3A | 3948538 | CTCGACGATCGACACGTGGCCAGGCCGGCGGAGCGGAGGCATGATCGTCATCACTTCCATCC TGGGCTCCCTGCCCTTCTTTCTACTTGTGGGTTTTGCTGGCGCCATTGCCC |
| 3855 | UPK3A | 3948540 | AGTTCTGATGGGGAAACGACTCACGACTCCCAAATCACTCAGGAGGCTGTTCCCAAGTCGCT GGGGGCCTCGGAGTCTTCCTACACGTCCGTGAAC |
| 3856 | UPK3A | 3948541 | GTGTATTCCAGCAAGCTCCAAGACTGA |
| 3857 | UPK3A | 3948542 | GCCCTGCAGCGGTGGTTGTCACACCCTGACTTCA |
| 3858 | PLXNB2 | 3965814 | GCTGCCTTGGGACATAGGTACCTGAGGTACCTGAGAGCCCCTCAGGGGAGGAGGCCGAGTG GCTGTGGCTGAGGCCCCCACCCTCCCCTGGAACGCGCCCCAAGCCGGAGTGGGTGCAGCCGG AACCCGCCCAGCGTCTAGACTGTAGCATCTTCCTCTGAGCAATACCGCCGGGCACCGCACCAG CACCAGCCCCAGCCCCAGCTCCCTCCGGCCGCAGAACCAGCATCGGGTGTTCACTGTCGAGTC TCCAGTGATTTGAAAATGTGCCTTACGCTGCCACGCTGGGGGCAGCTGGCCTCCGCCTCCGCC CACGCACCAGCAGCCGCCTCCATGCCCTAGGTTGGGCCCCTGGGGGATCTGAGGGCCTGTGG CCCCCAGGGCAAGTTCCCAGATCCTATG |
| 3859 | PLXNB2 | 3965816 | ACGGACTCCTTGAACACCCTCGTGGCACTCCACCAGCTCTACCAATACACGCAGAAGTACTAT GACGAG |
| 3860 | PLXNB2 | 3965819 | TACTACAAGGGGATCCGGCAGATGGTGCAGGTCAGCGACCAGGACA |
| 3861 | PLXNB2 | 3965820 | AGCTGCTGTACGCCAAGGAGATCTC |
| 3862 | STS | 3967692 | TTGGCCAAGCCTCCAGCAGCTGACGGGACCCAGCTGTAGTGAGGTTGCAGTGATTGAGTAGG ATTGGCCTGCTTCAAAGCAGAGGTTTCTCATGGGAATATGCTTATTAAACTCCCACTGGTGCA GAAACCATGAACAGAGGATGAACAAGTGAAGTTGCAATCTCCTCCATCACAG |
| 3863 | STS | 3967693 | AGTTCCCCAACAACAGGATCACAAGCTGGAG |
| 3864 | STS | 3967695 | TGGGAAGCCGAGAGCCACGCAGCATCAAGGCCGAACATCATCCTGGTGATGGCTGACGACCT CGGCATTGGA |
| 3865 | STS | 3967696 | CAATATCGACCGGTTGGCCAGTGGGGGAGTGAAACTCACTCAGCACCTGGCAGCATCACCGC TGTGCACACCAAGCAGGGCAGCCTTCATGACTGGCCGGTAC |
| 3866 | STS | 3967697 | GAATGGCATCTTGGTCCCGCACTGGAGTTTTCCTCTTCACAG |
| 3867 | STS | 3967698 | TCTTCGGGAGGACTTCCCACCGATGAGATTACCTTTGCTAAGCTTCTGAAGGA |
| 3868 | STS | 3967701 | TGAGCTGTCACAGCAAGACTGACTTCTGTCACCACCCTTTACATCACGGCTTCAATTATTTCTA TGGGATCTCTTTGACCAATCTGAGAGACTGCAAGCCCGGAGAG |
| 3869 | STS | 3967702 | GCTACTCCACGTGCCTCTAGGCGTTTTTTCAG |
| 3870 | STS | 3967708 | GAACACTGAGACTCCGTTCCTGCTTGTCTTG |
| 3871 | STS | 3967709 | CAAAAGTCAACACGGAGTCTACGGGGATG |
| 3872 | STS | 3967718 | GCTGAGATTGGCTAATGATACCCTCATCTACTTCACATCGGACCAGGGAGCACATGTAGAAG AAGTGTCTTCCAAAGGAGAAATTCATGGCGGAAGTAATGGGATCTA |
| 3873 | STS | 3967722 | CTTCGTTGGCCCAGGGTGATACAGGCTGGCCAGAAGATTGATGAGCCCACTAGCAACATGGA CATATTTCCTACAGTAGCCAAGCTGGCTGGAGCTCCCTTG |
| 3874 | STS | 3967725 | CATTGATGGACGTGATCTGATGCCCCTGCTTGAAGGAAAAAGCCAACGCTCCGATCATGAGTT TCTCTTCCATTACTGCAACGCCTACTTAAATGCTGTGCGCTGG |
| 3875 | STS | 3967735 | CATCTGGAAGGCCTTTTTCTTCACCCCCAACTTCAACCCCGTGGGTTCCAACGGATGCTTTGCC ACACACGTGTGCTTCTGTTTCGGGAGTTATGTCACCCATCACGAC |

TABLE 13-continued

Subtyping Target Sequences

| SEQ ID NO. | Gene | Affy Probeset ID | Sequence |
|---|---|---|---|
| 3876 | STS | 3967736 | GTGCCCGATCAGTTTTCATGGAACAACTTTCTTTGGAAGCCCTGGCTTCAGCTGTGCTGTCCTT<br>CCACCGGCCTGTCTTGCCAGTGTGATAGAGAAAAACAGGATAAGAGACTGAGCCGCTA |
| 3877 | STS | 3967737 | AGACAGACGCATGTGGCAAAGCTCACCATCTTCACTACAAACACGCCTGAGAGTGGCACTGG<br>GGAAACATAACTCCATCTACACCTTGGATTTGGACTGATTCTCCATTTTATCACCTGAAGGCTT<br>GGGCCAGAGCTCAACAGCTACTCAACTGGAGGGGTGAGGGGGATAAGGTCTGTAGTATACA<br>GACAGGAAGATGGTAGGTTTATGCCTTCTGTGGCCAGAGTCTTGGACTCATGGAAATAGAAT<br>GAATAGAGGGGCATTCACAAGGCACACCAGTGCAAGCAGATGACAAAAAGGTGCAGAAGGC<br>AATCTTAAAACAGAAAGGTGCAGGAGGTACCTTAACTCACCCCTCAGCAAATACCTATGTCAA<br>CAGTATAAGTTACCATTTACTCTATAATCTGCAGTGATGCAATAACCAGCATA |
| 3878 | STS | 3967738 | TTGGAAGGCAAGTCATTATTACTGGTATTAGTTAAAACACATATCAAATGCTTGCTCTTCATCA<br>TATATATAGTTATGCATACATACACACACACATACAGTATATTCTTTCCTCAAAAGGGTTAA<br>GATGTCTAAAATAGGGACCTAGAAGCTTAACACTATTTAAGTAAATACAGTAGAAGCTCACAA<br>ATAGATTTCTTTGCACAATGATTTTTTGCAAAATTTTACAGTAATAATAATCCCAAGGCAAATC<br>TCTCCTGAACTGCTTTCCATTCCATAATTTGTAGTATAATTCTTGGATTCCACTGTTTTCTTTGG<br>GGAATGGAAGTTCTGAATTAAAAGCCCACTGTGGAGATGCTGTGGTTCATGGAATCTCTTCCA<br>GTGTAATTCAGAATCATTGGCCTAGAAAGTCTCTG |
| 3879 | STS | 3967739 | ATGCAAGTTTTGTGACTGAGAAATTTCTGTGCTTCCAATCCACAATGAGATGCATGATTTTGTT |
| 3880 | STS | 3967740 | AATGCGCAACTGATCGCCTAGGAGAGGGCCTCGTAGTGGCACAGCTGGAGATAGTTTCAAAG<br>TCTAAACCACCAGCCCATCCTGAGGAAAGCCTCCTATGGAATGTAAAGTGCAATCATTTCTTC<br>AGATATAAGACTTTCCCCAACAATGTGATTGGATTCCTTTATGGCAAAATCGAGAGAAGCTGC<br>CATCCACCTGCTTATGCATTTATCTCTTTTGTGGACTTGTCTGACCACCTTCTATTTG |
| 3881 | STS | 3967741 | CCCACACAGCGGTTTGCAGAGAATGTTAGCCATGACTTGGGCTTTCTGAAAGTTGGCTATAAT<br>TTCTCTATCCCTACCCACAACCCTGGGAAGTTGGAGCAAGAGGGGCATACTATTGGGCTGGG<br>AGGATTTGACAGCATTTCCCCAGTTGCCCTTTAAGTTCTTCTATTTCAAACGTTAATTTTGCTTC<br>TCTTTCTAAAAAAAAAAAAAAAAAAGAAAGAGAAGAAAGAAGTGATTCCTACCCCCTACCTCC<br>AGAGTTGTTGAAAGCTGAAAAGCATACAAGATTCTTCCTTTTAACTTGGATTTCTCGTTCCAGA<br>AATTGTGGGATAATCTGTATTCTTGCTTTAGAAAACATTCTTAGAGAGGGTACTAGCTTACTG<br>ATGATGTGTTAGGATTGCTACTGATGCTGTCATGTGGAAACTATTTAAAGGCACTATTATAAA<br>TTTATCCTATAAGATGACAATGTTTACTCAAAGTCTAACATATTCAATGCAAGTAAGACTTTCT<br>GAAAACACTTTGATGATGTGGAAATGCTGCAGGATTAAATAACTTGAAGAGCCTTTATAGATTA<br>TATGAATGCCTATTTGTGTCTAGAACCAGTTATTTAACCTGTAAAATGTCAATAGCAAATGAA<br>GGATGAAGTATATCTCTAGATGCAAATACATTGAGTTTAAAAGTGCCTCAAAATAATTGAGAT<br>CACATTTCAGGACATTTGGAAATCAGGTCGATTTGTGGTAACTGTAGTCATCTTAAATTTCAAA<br>CCATTTACCATCTGAAAGTTTTGATTTGAATGTAAAACAGGAAATTGGAATTCCTTTGTCCAGG<br>AGAAACCTCACAAACCTTCTTTAAGGCATAGTTTTGTTGTTTGTTTGCTTGTTTGTTGCAGGCT<br>GTAAGGCATGGCTGCTTGTTTACAAAGCATCTCATTCATATTACCTGTGGAGTTGCATATCCAA<br>ACCTTAGTGA |
| 3882 | STS | 3967742 | CTCCGACCTCCATGATCCGAGAGTGGGAAAAGGCCCGATTATTACCCATAAGGCACACTCTCT<br>AAGGCCTTTTAAGGGGCCTACAAAAATGTTTTATTTTATAATCAGAAGAAAAGGAAATGAACA<br>TTGGGGATTGAAAATCATATTGGTATTTGCACCAACATAGTCATAAAATAGTATGTTAATATG<br>TTTTTACTTTATATATTTATATATTAAAATATATTTAATATGTTTTGCCTTTGTGGCCCATGAAAG<br>TCTTACTGGGCCCTGGGGAAGGTATCCTACCCTGGTGAAGCAGCTGCTTTGCTCTACAAATAC<br>CTGGGGCAGAAATTTGATTTGAAAAGTATTATTCTCTCTTCTCTTTGTTTCAACTGGATTCCTTT<br>GGAAAACCAAACTAGTATCAGAACAAACCCCGAAACAGTAAGAAATTGGAGTGAGAAGGGC<br>ATGGTATTGGGACTAGGATCGGCTCTCATTCGATCGAGCTATTCTTCTTAAAATGACAAAAAGT<br>GTCCATAAAGAGGCTGCTGGAGAGTGCGTGGCCATAGGGAGCCGACATGCCCGGGAGGAAA<br>GGTGTTGATTACATGGATACTTCTAAAAGCTAAAGCCTTGTTGCCTTCTCTTTAATGCCTAGAG<br>AATGGGATGTGTGATGCAAATGCTCAAAACCTCTTAAATCATAGCTGTCTGACCTCTACGGAC<br>CTCACATCCATCTGAGGCTTCATGGACAAAGATTCTCCACTTGGCCAAACTTTAGCCAAGCTCC<br>TCAACCTTCTCCCAGGCCCAATCTGGGCACTTCCTTGTAAAATCTAGTTTTGGCAAGAAGTCTA<br>TTAGGTCAGTTTAGCAAGAACACCTAACCCCCCCATATCTGTTCAACCTCAGTATCTGATCAGG<br>CTCCTCAGCCTCCACCATCCCCAGGTGATGTCTGGTCAACTGGCCTGCCTTCAGCTAGAATCC<br>TGTTAGGTCGGTTTAGATGAATGCTCCCTGATATTTCCTCTTGGTAATCTTCCATCCACTGCCCC<br>TGACCCTGTTCCCTGTCTATAAATCCCCAGTTTTCCATGGTGTATTCAGAGCTGAGTCCAGTCT<br>CTCTCCCCTACTACAAGTCCCCATTGCTGTGGTCCCCGTACCTGTCATGATGGTCCTAA |
| 3883 | STS | 3967743 | GAAACCTATTGGGACAGCATGACTGTGCAGGGTCTTTAGAGCTCAGCTTTCTGAGGCCCTGA<br>GCATTCTTGGTTTTCCGACATCGTGAACCTGTTCTG |
| 3884 | STS | 3967744 | GCTTCCTTGTTAGAATGCAAGCAGCTTAAAAACTACCCATGTCTTTCTGGAAAGGAAACATT<br>GCCATGTAACTATGTA |
| 3885 | SAT1 | 3971810 | CTCCTCCTACTGTTCAAGTACAGGGGCC |
| 3886 | SAT1 | 3971811 | CGCCCAGCCACTGCCGCCGACTGCAGTGACATACTGCGGCT |
| 3887 | SAT1 | 3971813 | ATGGAAGAACAAGTAATCTTAACTGAAA |

TABLE 13-continued

Subtyping Target Sequences

| SEQ ID NO. | Gene | Affy Probeset ID | Sequence |
|---|---|---|---|
| 3888 | SAT1 | 3971814 | CAACAGTGGCGGGACGGGGACAAGCGTTCGGTGCCTGTCACCTTCGCCAAGGCCATTACCG CCCCTGCTC |
| 3889 | SAT1 | 3971815 | CCTTTTACCACTGCCTGGTTGCAGAAGTGCCGAAAG |
| 3890 | SAT1 | 3971816 | GTCGGCTGTGTAGAACCACTGACTACACAGGCCGAAGTTACTGAGAACTTGGACAGAAAAAA TAGCCAGCAAGTGTTCAAACTACTGAGGAAAAAAAAAAATTAGATATGCTGCACTTAAGAAT ACTAGGGCAGGTTAAAAGAGCTG |
| 3891 | SAT1 | 3971817 | GACTCGGAAGTGTTTAAGCTGCTTAAGTAAGTATAAGTGCTGTGGAGACCCGGAAGAGTTAG ATATAATGTCATTTGTTGTAATTCAGTTTCATAAAATGGTTCTTGTTTGACCCTAACGTAACAGT TTTTGTAATTGTGTTAAATCACATTTTTTTCTTTAATTTGTCCCAATCTTCAG |
| 3892 | SAT1 | 3971818 | GTTACAGTCTCTAGCTTCGCCATGTACATGGCCCTTCCGTGT |
| 3893 | SAT1 | 3971819 | CTAAAAGATCCTTTACACAATAAAGTAGATGATCATGATAAATG |
| 3894 | SAT1 | 3971821 | GTGTGCTTTTTGCAAATACATGTTCTCAGAACAGTGAGATCATCCAGCAGTGGCCTGGACTGC ACTCACATAAAAATCATGAGACAGCCATGGCTACTTGTTTCTGTAATACATGCATGTGTGTTTT TTAAAACCTATGATAGGCCTCTGATTCTGCAGCTGCAACTTTTATGGAATGTT |
| 3895 | SAT1 | 3971822 | CTATTTTACCTATGACCCGTGGATTGGCAAGTTATTGTATCTTGAGGACTTCTTCGTGATGAGT GATTATAGA |
| 3896 | SAT1 | 3971823 | GTTCGGAGCAGAGGGTCTGAAGAGAGTTCAGAGTTATAAATGCTTACAATGACTTTT |
| 3897 | SAT1 | 3971824 | GCTTTGGCATAGGATCAGAAATTCTG |
| 3898 | SAT1 | 3971826 | TGCAATGAGGTGTCGCTGCAGCAGCATGCACTTCTTGGTAGCAGAATGGAATGAACCATCCA TCAACTTCTATAAAAGAAGAGGTGCTTCTGATCTGTCCAGTGAAGAGGGTTGGAGACTGTTCA AGATCGACAAGGAGTACT |
| 3899 | SAT1 | 3971827 | GGAGTGCTGCTGTAGATGACAACCTCCATTC |
| 3900 | SAT1 | 3971828 | TTCCAAAGCTTTATTACCAGTGGCGTTGTTGCATGTTTGAAATGAGGTCTGTTTAAAGTGGCA ATCTCAGATGCAGTTTGGAGAGTCAGATCTTTCTCCTTGAATATCTTTCGATAAACAACAAGGT GGTGTGATCTTAATATATTTGAAAAAAACTTCATTCTCGTGAGTCATTTAAATGTGTACAATGT ACACACTGGTACTTAGAGTTTC |
| 3901 | TIMP1 | 3976342 | TGAGTAATGCATCCAGGAAGCCTGGAGGCCTGTGGTTTCCGCACCCGCTGCCACCCCCGCCCC TAGCGTGGACATTTATCCTCTAGCGCTCAGGCCCTGCCGCCATCGCCGCAGATCCAGCGCCCA GAGAGA |
| 3902 | TIMP1 | 3976346 | ATCAGGGCCAAGTTCGTGGGGACACCAGAAGTCAACCAGACCACCTTATACCAGCGTTATGA GATCAAGATGA |
| 3903 | TIMP1 | 3976349 | ATGTATAAAGGGTTCCAAGCCTTAGGGGATGCCGCTGACATCCGGTTCGTCTACACCCCCGCC ATGGAGAGTGTCTGCGGATACTTCCACAG |
| 3904 | TIMP1 | 3976350 | GTCCCACAACCGCAGCGAGGAGTTTCT |
| 3905 | TIMP1 | 3976351 | CTGGGGCGCGGCCTAGCAACCACGAGGGGGCGAGGCTCTGATGGGAATGGTCCCACTGGAA ATGGGGACCACCCCAATTTCAGTCTATCAGAAGGCCGGGCCTTTGGCAGCTTGGCAGCTCAG CCAATCACAAGCTGCTTGTCGG |
| 3906 | TIMP1 | 3976352 | CTGCAGGATGGACTCTTGCACATCACTACCTGCAGTTTTGTGGCTCCCTGGAACAGCCTGAGC TTAGCTCAGCGCCGGGGCTTCACCAAGACCTACACTGTTG |
| 3907 | TIMP1 | 3976353 | TGGACCCTGACCTCCAACGGGAGATCCTTCCC |
| 3908 | TIMP1 | 3976354 | GCCCGAGACTGCTCCCTTACAAATTCTGGCTGCTCCCTTTCCCTGTGTCCAATACCGTGTGATC ACCTGTCCCTCCCTGGTCCCTCTAATTCTCCCTTGTGA |
| 3909 | TIMP1 | 3976356 | TTTCCCTGTTTATCCATCCCCTGCA |
| 3910 | TIMP1 | 3976357 | CTTCCAGTCCCGTCACCTTGCCTGCCT |
| 3911 | TIMP1 | 3976358 | AGTCCCTGCGGTCCCAGATAGCCTGA |
| 3912 | TIMP1 | 3976359 | GCCTGCACAGTGTCCACCCTGTTCCCACTCCCATCTTTCTTCCGGACAATGAAA |
| 3913 | PLP2 | 3977069 | ATGGCGGATTCTGAGCGCCTCTCGGCTCCTGGCTGCTGGGCCGCCTGCACCAACTTCTCGCGC ACTCGAAAGGGAATCCTCCTGTTTGCTG |

TABLE 13-continued

Subtyping Target Sequences

| SEQ ID NO. | Gene | Affy Probeset ID | Sequence |
|---|---|---|---|
| 3914 | PLP2 | 3977072 | TGATCTGCTTCAGTGCCTCCACACCAGGCTACTCCTCCCTGTCGGTGATTGAGATGATCCTTGC<br>TGCTATTTTCTTTGTTGTCTACATGTGTGACCTGCACACCAAGATACCATTCATCAACTGGCCC |
| 3915 | PLP2 | 3977073 | GATTTCTTCCGAACCCTCATAGCGGCAATCCTCTACCTGATCACCTCCATTGTTGTCCTTGTTG |
| 3916 | PLP2 | 3977074 | TTTGAGGAGCCAGGGACCATTTCTGCCTTTGCTTCTGGCAGAAATCGTGTGACCCACAGCAAG<br>TCACACTTGTCCTCAGACATGGAGGAAAGTCTGGCCCAGGACTTGGTTTTGCCTCCCAAGGTC<br>TTCATTTGCTG |
| 3917 | PLP2 | 3977075 | GTACTGGGCCTAATCGCTACGTGCCTCTTTGGCTATGATGCCTATGTCACCTTCCCCGTTCGGC<br>AGCCAAGACATACAGCA |
| 3918 | PLP2 | 3977076 | CCATATGTGTGTGCCTAGGTCCTCCTTCTGCACGATCCAATAGGAGACACCAGTTCTGACTGA<br>ACCATGCCCCCACCTAAGTCACAAAATGAGGGAAGTGGGGAGTTAGATTTCAGAGTCCAGGC<br>CCTAGGTTGGGACCCACTCCAAATAATCTCCTCGGTGTGGGTG |
| 3919 | PLP2 | 3977077 | TGGAGTGGAAACAGCTGGGCAAGGAGGCAAAGAAGCCAGGCCTGTTTTACAACAA |
| 3920 | KRT18 | 3983630 | ATGCGCCAGTCTGTGGAGAACGACATCCATGGGCTCCGCAAG |
| 3921 | BEX4 | 3985495 | CGGCGGCGCACCTCGCGTCAAGAATCCGGAGGAGGAGA |
| 3922 | BEX4 | 3985497 | TCCAAAGAGGAACTAGCGGCAAACAATCTCAACGGGAAAATGCCCAACAAGAAAACGAAG<br>GAGGGGAGCAGGCCCCCACGCAGAATGAAGAAGAATCCCGCCATTTGGGAGGGGTGAAG<br>GCCAGAAGCCTGGAGGAAATATCAGGCGGGGGCGAGTTAGGCGACTTGTCCCTAATTTTCGA<br>TGGGCCATACCTAATAGGCATATTG |
| 3923 | BEX4 | 3985498 | GCAGATGAGGCACTATATGCGCTTCCAAACTCCTGAACCTGACAACCATTATGACTTTTGCCTC<br>ATACCTTG |
| 3924 | BEX4 | 3985499 | TTGTCTCAGCCTAAAAGTTACGGTCAGCATGGCAATTCACCTATTTTAGGAAAAATACTCTTTT<br>CATAATATGAAATGCATAAAGCAGTTCAAAAAGCAGTCTGTATTCCATCATCTTCCTTTTTCAT<br>TCCAGTCCTTATTTTTGTAAGTATTACTTTTCCTCCTCCGGCTACCTGGACTCAAAATCTCAGTT<br>GTCTTTGACAGTTTTTTCTTGTCCCTGACCAAAAAGAATGATCATACCCAGAATTCAATGTT<br>TGATATTTTAAGAATGTATGTTCTAGTGTTTTTCAGAGTGAGTCTACCATCTGTATAAAAACAC<br>CTTGGGGGCAGGCAGGGGCATTTAAAAATGTAGGACCTATCGTCCAGACTCACAGAGTGGG<br>GCTC |
| 3925 | RNF128 | 3986262 | AGTGAAATAGAGCTGATGTATCCAGAGGTTATGTTGCTAG |
| 3926 | RNF128 | 3986263 | GTGAGATCAGTTACCTACGTGCAACTGAAATTTCAAACTTCTGTTCAGCAGGGACGTGAGTGG<br>ACAATGGTGACTGATAGTTGGAAATA |
| 3927 | RNF128 | 3986264 | ATGAACCAGGAGAATAGGTCCAGTTT |
| 3928 | RNF128 | 3986265 | TGGCGTTTATGGATTAGCTTCACCAGTGGCTAATGCTATGGGAGTGGTAGGCATCCCTAAGA<br>ACAATAACTACCAAGCTTGTGACCACAACACTGAGTTTAGTAATACTAAGAAGCCCTGGATTG<br>CGCTGATAGAAAGAGGTAATTGTACATTTTCAGAAAAAATTCAAACAGCGGGCAGAAGAAAT<br>GCTGATGCTGTTGTGATTTACAATGCTCCAGAGACTGGCAATCAGACGATA |
| 3929 | RNF128 | 3986267 | GGCAACCTGTGTGCTGACGCTACGTGCCTCCTGGCTCCGACGTAGCTCGCAGCTCCCCAGTCT<br>CACTCCATTCCTTCCCCACCTGGCGCGCACCTGCTCAAGACCAGGGTCCTGCCAAGCGCTAG |
| 3930 | RNF128 | 3986268 | GCGGTGGCTGCGGCTTTTCCAGATTGCTGG |
| 3931 | RNF128 | 3986269 | CGAATTTCACGGTGCCCACGGTTTGGGGAAGCACCGTGCAAGTCTCTTGGTTGGCCCTCATCC<br>AACGCGGCGGGGGCTGCACCTTCGCAGACAAGATCCATCTGGCTTATGAGAGAGGGGCGTC<br>TGGAGCCGTCATCTTTAACTTC |
| 3932 | RNF128 | 3986272 | GGCACAAAAATTCTGCAATCTATTCAAAGAGGCATACAAGTGACAATGGTCA |
| 3933 | RNF128 | 3986273 | AACATGGCCCTTGGGTGAATCACTATTCAATTTTTTTCGTTTCTGTGTCCTTTTTTATTATTACG<br>GCGGCAACTGTGGGCTATTTTATCTTTTATTCTGCTCGAAGGCTACGGAATGCAAGA |
| 3934 | RNF128 | 3986275 | AAGCTATTGGAAGGCTTCAACTACGCACACTGAAACAAGG |
| 3935 | RNF128 | 3986277 | ATGTGTTGACCCATGGCTGTTAGAACACAGGACTTGCCCCATGTGCAAATGTGACATACTCAA<br>AGC |
| 3936 | RNF128 | 3986278 | GTGTCTTTACAAGTCCCTGTATCCAATGAAATATCTAATAGTGCCTCCTCCCATGAAGAGGATA<br>ATCGCAGCGAGACCGCATCATCTGGATATGCTTCAGTACAGGGAACAGATGAACCGCCTCTG<br>GAGGAACACGTGCAGTCAACA |

TABLE 13-continued

Subtyping Target Sequences

| SEQ ID NO. | Gene | Affy Probeset ID | Sequence |
|---|---|---|---|
| 3937 | RNF128 | 3986279 | CTGTGGCAGTGGATGTTATTCCTCATGTTGACAACCCAACCTTTGAAGAAGACGAAACTCCTAATCAAGAGACTGCT |
| 3938 | RNF128 | 3986280 | GCCAATCAGGGCCTAGTTTCTATTAATAAATTGGATAAATTTAATAAAATAAGAGTGATACTGAAAGTGCTCAGATGACTAATATTATGCTATAGTTAAATGGCTTAAAATATTTAACCTGTTAACTTTTTTCCACAAACTCATTATAATATTTTTCATAGGCAAGTTTCCTCTCAGTAGTGATAACAACATTTTTAGACATTCAAAACTGTCTTCAAGAAGTCACGTTTTTCATTTATAACAATTTTCTTATAAAAACATGTTGCTTTTAAAATGTGGAGTAGCTGTAATCACTTTATTTTATGATAGTATCTTAATGAAAAATACTACTTCTTTAGCTTGGGCTACATGTGTCAGGGTTTTTCTCCAGGTGCTTATATTGATCTGGAATTGTAATGTAAAAGCAATGCAAACTTAGGCGAGTACTTCTTGAAATGTCTATTTAAGCTGCTTTAAGTTAATAGAAAAGATTAAAGCAAAATATTCATTTTTACTTTTTCTTATTTTTAAAATTAGGCTGAATGTACTTCATGTGATTTGTCAACCATAGTTTATCAGAGATTATGGACTTAATTGATTGGTATATTAGTGACATCAACTTGACACAAGATTAGACAAAAAATTCCTTACAAAATACTGTGTAACTATTTCTCAAACTTGTGGGATTTTTCAAAAGCTCAGTATATGAATCATCATACTGTTTGAAATTGCTAATGACAGAGTAAGTAACACTAATATTGGTCATTGATCTTCGTTCATGAATTAGTCTACAGAAAAAAATGTTCTGTAAAATTAGTCTGTTGAAAATGTTTTCCAAACAATGTTACTTTGAAAATTGAGTTTATGTTGACCTAAATGGGCTAAAATTACATTAGATAAACTAAAATTCTGTCCGTGTAACTATAAATTTTGTGAATGCATTTTCCTGGTGTTTGAAAAAGAAGGGGGGGAGAATTCCAGGTGCCTTAATA |
| 3939 | VGLL1 | 3992547 | GTGGGGGTACAAATCCTCAGCTCCTGCTTCCGCAAGCACTAACCTGCTCTGAAGTGAGCCAGGCAGCTC |
| 3940 | VGLL1 | 3992549 | CTGTCACCTGTGTCATTCACTCACA |
| 3941 | VGLL1 | 3992550 | GAAGACTGCCATCCGGCTGCCCAAAGGCAAACAGAAGCCTATAAAGACGGAATGGAATTCCCGGTGTGTCCTTTTCACCTACTTCCAAGGGGACATCAGCAGCGTAGTGGATGAACA |
| 3942 | VGLL1 | 3992554 | TGGCGTTACTCGTCTCCATGGACAAAGCCACAACCAGAAGTACCTGTCACAAACCGTGCCGCCAACTGCAACTTGCATGTGCCTGGTCCCATGGCTGTGAATCAGTTCTCACCGTCCCTG |
| 3943 | VGLL1 | 3992555 | AGCAAGACAGATGCCTAGCCCGTCCTCAGGAATCTGCCGCCAGGGAGAATGGCAACCCTGGCCAGATAGCTGGAAGC |
| 3944 | VGLL1 | 3992556 | AGGTCTTCATGCTCTACTCATGTTGACATGAGTTGTATTAATTGGTGACTGGAAGTCCAGGATCTGTTGAGGAAGTCAGTGACCCTTAATCAGGAACACTGCCTTGGAAGGTGGTGGACCTTTAAACAGAAGCTTCTCAGTTTTTGTAGCATCTGATATGAGAGAATATGCTAGATATTCATAAACTTAGGGCCAGGCAATGTGGGCCCCTGGAATGCTACTGGGCACTCTCTAACCTAGTCCTAGA |
| 3945 | VGLL1 | 3992557 | AGAAACTATATGTATCTCGTGGATCTGCCAGTACCAGCC |
| 3946 | VGLL1 | 3992563 | CCTGGGAAATACTCACTTACACCACCAAACCACTGGGGCCACCCACATCGATACCTGCAGCA |
| 3947 | VGLL1 | 3992564 | GAGAAAGACAACACTTGGTCTAAGACACGGCAGCAAGACATCCTGCATATTGTTCCAGA |
| 3948 | VGLL1 | 3992565 | ACTTGCCTCCCCAATCTGTTAAACAGCTTCGTGTCTAGTATGAGCTCAGTACTTGCCCTGTGAAATCCCAGAAGCCCCCGCTGTCAATGTTCCC |
| 3949 | BGN | 3995635 | AGTAGCTGCTTTCGGTCCGCCGGACACACCGGACAGATAGACGTGCGGACGGCCCACCACCCCAGCCCGCCAACTAGTCAGCCTGCGCCTG |
| 3950 | BGN | 3995641 | CCTGTGGCGCCTCGTGTCTCTGCTGGCCCTGAG |
| 3951 | BGN | 3995642 | GGACTTCACCCTGGACGATGGGCCATTCATGATGAACGATGAGGAAGCTTCGGGCGCTGACAC |
| 3952 | BGN | 3995643 | GGGCGTCCTGGACCCGGACTCTGTC |
| 3953 | BGN | 3995644 | GTGTCCTTTCGGCTGCCACTGCCACCTGCGGGTGGTTCAGTGCTCCGACCT |
| 3954 | BGN | 3995650 | AAAGAGATCTCCCCTGACACCACGCTG |
| 3955 | BGN | 3995651 | TGCAGAACAACGACATCTCCGAGCTCCGCAAGGATGA |
| 3956 | BGN | 3995652 | ACCAGCAGGCCTACAGCAGAGGGCAGG |
| 3957 | BGN | 3995654 | GCCCTCGTCCTGGTGAACAACAAGATCTCCAAGATCCATGAGAAGGCCTTCAGCCCACTGCGGAAG |
| 3958 | BGN | 3995657 | ATGGGCGGGAACCCACTGGAGAACAGTGGCTTTGAACCTGGAGCCTTCGATGGCCTGAAGCTCAACTACCTGCGCATCTCAGA |
| 3959 | BGN | 3995659 | AGACCCTGAATGAACTCCACCTAGACCACAACAAAATCCAGGCCATCGAACTGGAGGACCTGCTTCGCTACTCCAAGCTG |

TABLE 13-continued

Subtyping Target Sequences

| SEQ ID NO. | Gene | Affy Probeset ID | Sequence |
|---|---|---|---|
| 3960 | BGN | 3995660 | GGGCCTAGGCCACAACCAGATCAGGATGATCGAGAACGGGAGCCTGAGCTTCCTGCCCACCC<br>TCCGGGAGCTCCACTTGGACAACAACAAGTTGGCCAGGGTGCCCTCAGGGC |
| 3961 | BGN | 3995661 | GTGGTCTATCTGCACTCCAACAACATCACCAAAGTGGGTGTCAACGACTTCTGTCCCATGGGC<br>TTCGGGGTGAAGCGGGCCTACTACAACGGCATCAGCCTCTTCAACAACCCCGTGCCCTACTGG<br>GAGGTGCAGCCGGCCACTTT |
| 3962 | BGN | 3995662 | GGGGAACACAGCCAGACATCCTGATGGGGAGGCAGAGCCAGGAAGCTAAGCCAGGGCCCA<br>GCTGCGTCCAACCCAGCCCCCCACCTCGGGTCCCTGACCCCAGCTCGATGCCCCATCACCGCC<br>TCTCCCTGGCTCCCAAGGGTGCAGGTGGGCGCAAGGCCCGGCCCCCATCACATGTTCCCTTGG<br>CCTCAGAG |
| 3963 | BGN | 3995663 | TCCAGTCCTAGGAGAACAGTCCCTGGGTCAGCAGCCAGGAGGCGGTCCATAAGAATGGGGA<br>CAGTGGGCTCTGCCAGGGCTGCCGCACCTGTCCAGACACACATGTTCTGTTCCTCCTCCTCATG<br>CATTTCCAGCCTTTCAACCCTCCCCGACTCTGCGGCTCCCCTCAGCCCCCTTGCAAGTTCATGG<br>CCTGTCCCTCCCAGACCCCTGCTCCACTGGCCCTTCGACCAGTCCTCCCTTCTGTTCTCTCTTTC<br>CCCGTCCTTCCTCTCTCTCTCTCTCTCTCTCTCTTTCTGTGTGTGTGTGTGTGTGT<br>GTGTGTGTGTGTGTGTGTCTTGTGCTTCCTCAGACCTTTCTCGCTTCTGAGCTTGGTGGC<br>CTGTTCCCTCCATCTCTCCGAACCTGGCTTGCCTGTCCCTTTCACTCCACACCCTCTGGCCTTC<br>TGCCTTGAGCTGGGACTGCTTTCTGTCTGTCCGGCCTGCACCCAGCCCCTGCCCACAAAACCCC<br>AGGGACAGCAGTCTCCCCAGCCTGCCCTGCTCAGGCCTTGCCCCAAACCTGTACTGTCCCGG<br>AGGAGGTTGGGAGGTGGAGGCCCAGCATCCCGCGCAGATGACACCATCAACCGCCAGAGTC<br>CCAGACACCGGTTTTCCT |
| 3964 | BGN | 3995664 | GGGCTGCTTCTGAGGTCGGTGGCTGTCTTTCCATTA |
| 3965 | FLNA | 4027177 | CTGCCCTGTGCCGTGCTGCGCTCACCTGCCTCCCCAGCCAGCCGCTGACCTCTCGGCTTTCACT<br>TGGGCAGAGGGAGCCATTTGGTGGCGCTGCTTGTCTTCTT |
| 3966 | FLNA | 4027178 | GGACCCCCTGCGAGGAGATCCTGGTGAAGCACGTGGGCAGCCGGCTCTACAGCGTGTCCTAC<br>CTGCTCAAGGACAAGGGGGAGTACACACTGGTGGTCAAATGGGGGGACGAGCACATCCC |
| 3967 | FLNA | 4027179 | CTCCACGAGACATCATCAGTGTTTGTAGACTCTCTGACCAAGGCCACCTGTGCCCCCCAGCAT<br>GGGGCCCCGGGTCCTGGGCCTGCTGACGCCAGCAAGGTGGTGGCCAAGGGCCTGGGGCTGA<br>GCAAGGCCTACGTAGGCCAGAAGAGCAGCTTCACAGTAGACTGCAGCAAAGC |
| 3968 | FLNA | 4027180 | CGTGAACACGAGCAATGCGGGAGCTGGTGCCCTGTCGGTGACCATTGACGGCCCCTCCAAGG<br>TGAAGATGGATTGCAGGAGTGCCCTGAGGGCTACCGCGTCACCTATACCCCCATGGCACCT<br>GGCAGCTACCTCATCTCCATCAAGTACGGCGGCCC |
| 3969 | FLNA | 4027181 | GTAAGTCTGTCGGTGCGGCTGCACGTGTGCACACAGCTGCTAGGCCCTTGCCTCCAAGCTCTT<br>GGTGACAACAGGAGGCACCTGGAGGTGACAAGCCTGTGCTGGGTGGCCGAGGACAGGGAG<br>GCA |
| 3970 | FLNA | 4027182 | GAATGGCGTTTACCTGATTGACGTCAAGTTCAACGGCACCCACATCCCTGGAAGCCCCTTCAA<br>GATCCGAGTTGGGGAGCCTGGGCATGGAGGGGACCCAGGCTTGGTGTCTGCTTACGGAGCA<br>GGTCTGGAAGGCGGTGTCACAG |
| 3971 | FLNA | 4027183 | ACACCATCTGCTGGTTTGAGGAGGGGCCCCAGGCCCACAGCATGACTCCCTGCTCCTCAG |
| 3972 | FLNA | 4027184 | TGGCTCGCCACCCACAGCTATTAGGAAGGCCTTCTACCCTGCAGTACCATGCCATCTCCACAG<br>GGAAAGACTCAAAGTCCAGCCTCAGTGCTGCCCGGCCCTTCAGCCACGGCCATGGTACTTGT<br>GCACAGGCCTGGGGCAGCCTTGTGGGTAGGAGGAGCCCAGTGGGCTTCATTTCACGGCCTA<br>GTCCTGCCCTTCCCAGCTGCATGACCTGAAGCAAGTTCCTGCCCGTCTCTGAGCCTGTTAACAT<br>GCAGGGGATATGGTGTTCACGGTAACCTTTCTTAGGAGGCAGCAAGGCCTGGGTTTGGCTTG<br>TAAAAGATTTCCGTCCCAATGCACCCTGACGGTGGGCAGCTTGAGTGTCTAAACCTTCGGCCC<br>TCAGGA |
| 3973 | FLNA | 4027185 | AGGGCTAAAGGTCAACCAGCCAGCCTCTTTTGCAGTCAGCCTGAACGGGGCCAAGGGGGCG<br>ATCGATGCCAAGGTGCACAGCCCCTCAGGAGCCCTGGAGGAGTGCTATGTCACAGAAATTGA<br>CCAAG |
| 3974 | FLNA | 4027186 | GTAAGTGCGACCCGCGGGCCTCTTGCTCCTGGGGCCTTTCCGTCCTCCCTTGCCCTGGCTCAA<br>GCACCCCCATCTAACCATGTCTGCTGTG |
| 3975 | FLNA | 4027187 | ACCTGGGTGTGTGCGACGGCAGAGTGTGGGGCAGGGCGGGATGTGCGCCTGTGGCTT<br>GCTGCCCCTTGCAAATCAGTGGCTCTCCCTCTTTAAACCAAGTTGGACGCCAGATGG |
| 3976 | FLNA | 4027188 | GTGAGGCACCGAGAGAAACCGCCCACCTGGGGCTCCTGGGCCCGGACAGACCAGAGCCACC<br>GCAGAGACCAGGCCTTGGCCCTGTGTTCAGTGACCCCCCTGGCCCAGCTCTGGGTTCCAGGCC<br>TCTGCTCTGGCCGGGTGCAGCCCACGCTTGGGGTCGGCAGGAAATATCCTGCCCACCACGTG<br>GAGTTTTTCTCGTGTCTCA |
| 3977 | FLNA | 4027189 | TGTGGCTTCTCCGTCTGGCGACGCCCGCCGCCTCACTGTTTCTAGCCTTC |

TABLE 13-continued

Subtyping Target Sequences

| SEQ ID NO. | Gene | Affy Probeset ID | Sequence |
|---|---|---|---|
| 3978 | FLNA | 4027190 | CTACGAAGTCTCAGTCAAGTTCAACGAGGAACACATTCCCGACA |
| 3979 | FLNA | 4027191 | GCCTGAGTGTGGGTATTGGACCCAGGGCTGGCACAGATAGCCCTGCCTGGCACTCACTCTTC ACTTTGAGGTCACAGGGCCACCCAGGCTGTTCG |
| 3980 | FLNA | 4027192 | AATTCAGTATCTGGACCCGGGAAGCTGGTGCTGGAGGCCTGGCCATTGCTGTCGAGGGCCCC AGCAAGGCTGAGATCTCTTTTGAGGACCGCAAGGACGGCTCCTGTGGTGTGGCTTATGTGGT CCA |
| 3981 | FLNA | 4027194 | GGGCAAGACCCATGAGGCCGAGATCGTGGAAGGGGAGAACCACACCTACTGCATCCGCTTT GTTCCCGCTGAGATGGGCACACACACAGTCAGCGTGAAGTACAAGGGCCA |
| 3982 | FLNA | 4027196 | GGGCCGGGTGAAAGAGAGCATCACCCGCAGGCGTCGGGCTCCTTCAGTGGCCAACGTTGGT AGTCATTGTGACCTCAGCCTG |
| 3983 | FLNA | 4027197 | TCGGCAGCCCCCCTCACTACACCAG |
| 3984 | FLNA | 4027198 | TACATCATCAACATCAAGTTTGCCGACCAGCACGTGCCTG |
| 3985 | FLNA | 4027199 | GGCTCAGCCTGTCCATTGAGGGCCCCAGCAAGGTGGACATCAACACAGAGGACCTGGAGGA CGGGACGTGCAGGGTCACCTACTGCCC |
| 3986 | FLNA | 4027200 | ACCGAGGCTCAGGGGTATCCATCCCC |
| 3987 | FLNA | 4027201 | CCGGTGGTGATCAGCCAGTCGGAAATTGGGGATGCCAGTCGTGTTCGGGTCTCTGGTCAGGG CCTTCACGAAGGCCACACCTTTGAGCCTGCAGAGTTTATCATTGATACCCGCGATGCA |
| 3988 | FLNA | 4027202 | TCCCACCTAAAGGTCGGCTCTGCTGCCGACATCCCCATCAACATCTCAGAGACGGATCTCAGC CTGCTGACGGCCACTGTGGTCCCGCCCTCGGGCCGGGAGGAGCCCTGTTTGCTGAAGCGGCT GCGTAATGGCCAC |
| 3989 | FLNA | 4027203 | CATTGAGGGCCCGTCCAAAGCAGAAATCAGCTGCACTGACAACCAGGATGGGACATGCAGC GTGTCCTACCTGCCTGTGCTGCCGGGGGACTACAGCATTCTAGTCAAGTACAATGAACAGCAC GTCCCAGGCAGCC |
| 3990 | FLNA | 4027205 | TTCTATGTGGATTACGTCAACTGTGGCCATGTCACTGCCTATGGGCCTGGCCTCA |
| 3991 | FLNA | 4027206 | ACACACGAGGCTGCCATTCCACAAGG |
| 3992 | FLNA | 4027207 | GTGGCGCAGCCCACCATCACTGACAACAAAGACGGCACCGTGACCGTGCGGTATGCACCCAG CGAGGCTGGCCTGCACGAGATGGACATCCGCTATG |
| 3993 | FLNA | 4027208 | TTCACCATCAAGAAGGGCGAGATCACAG |
| 3994 | FLNA | 4027209 | CTGGCTGGGGACCAGCCCTCGGTGCAGCCCCTCTACGGTCTCAGCAGCTGGCCCCACAGTA CACCTACGCCCAGGGCGGC |
| 3995 | FLNA | 4027210 | CCACCATTCAGATTGGGGAGGAGACGGTGATCACTGTGGACACTAAGGCGGCAGGCAAAGG CAAAGTGACGTGCACCGTGTGCACGCCTGATGGCTCAGAGGTGGATGTGGACGTGGTGGAG AATGAGGACGGCACTTTCGACATCTTCTACACGGCCCCCCAGCCGGGCAAATACGTCATCTGT GTGCGCTTTGGTG |
| 3996 | FLNA | 4027215 | CAAGACAACCATGACGGCACGTATACAGTGGCCTACGTGCCAGACGTGACAGGTCGCTACAC CATCCTCATCAAGTACGGTGGTGACGAGATCCC |
| 3997 | FLNA | 4027216 | AAGGTGCTGCCTACTCATGATGCCAGCAAGGTGAAGGCCAGTGGCCCCGGGCTCAACACCAC TGGCGTGCCTGCCAGCCTGCCCGTGGAGTTCACCATCGATGCAAAGGACGCCGGGGA |
| 3998 | FLNA | 4027217 | AGCCAGTGGACGTGGTAGACAACGCTGATGGCACCCAGACCGTCAATTATGTGCCCAGCCGA GAA |
| 3999 | FLNA | 4027218 | GGAGGCCCAGGAGACTAGCTGATGCT |
| 4000 | FLNA | 4027220 | CCTGAGCCCAGGCATGGTTCGTGCCAACCTCCCTCAGTCCTTCCAGGTGGACACAAGCAAGGC TGGTGTGGCCCCATTGCAGGTCAAAGTGCAAGGGCCCAAAG |
| 4001 | FLNA | 4027221 | TTTCAAGGTCCCTGTGCATGATGTGACAGATGCGTCCAAGGTCA |
| 4002 | FLNA | 4027223 | ACGGCAGCTGCTCGGTCGAGTACATCCCTTATGAGGCTGGCACCTACAGCCTCAACGTCACCT ATGGTGGCCATCAAGTGCCAG |
| 4003 | FLNA | 4027227 | GCGCAGCTCGAGTGCTTGGACAATGGGGATGGCACATGTTCCGTGTCCTACGTGCCCACCGA GCCCGGGGACTACAACATCAACATCCTCTTCGCTGACACCCACATCCCTGGCTCCCCATTCAAG |

TABLE 13-continued

Subtyping Target Sequences

| SEQ ID NO. | Gene | Affy Probeset ID | Sequence |
|---|---|---|---|
| | | | GCCCACGTGGTTCCCTGCTTTGACGCATCCAAAGTCAAGTGCTCAGGCCCCGGGCTGGAGCG GGCCACCGCTGGGGAGGTGGGCCAATTCCAAGTGGACTGCTCGAGCGCGGGCAGCGCGGA GCTGACCATTGAGATCTGCTCGGAGGCGGGGCTTCCGGCCGAGGTGTACATCCAGGACCACG GTGATGGCACGCACACCATTACCTACATTCCCCTCTGCCCCGGGGCCTACACCGTCACCATCA AGTACGGCGGCCAGC |
| 4004 | FLNA | 4027229 | TCAAATCAAAGGGTGCTGGTGGTCAAGGCAAAGTGGCATCCAAGATTGTGGGCCCCTCGGGT GCAGCGGTGCCCTGCAAGGTGGAGCCAGGCCTGGGGGCTGACAACAGTGTGGTGCGCTTCC TGCCCCGTGAGGAAGGGCCCTATGAGGTGGAGGTGACCTATGACGGCGTGCCCGT |
| 4005 | FLNA | 4027230 | TAGGCGTCAATGTCACTTATGGAGGGGATCCCATCCCTAAGAGCCCTTTCTCAGT |
| 4006 | FLNA | 4027231 | CACAGTAAATGCCAAAGCTGCTGGCAAAGGCAAGCTGGACGTCCAGTTCTCAGGACTCACCA AGGGGGATGCAGTGCGAGATGTGGACATCATCGACCACCATGACAACACCTACACAGTCAAG TACACGCCTG |
| 4007 | FLNA | 4027232 | CCCATCCGAGTCAAGGTGGAGCCCTCTCATGACGCCAGTAAGGTGAAGGCCGAGGGCC |
| 4008 | FLNA | 4027233 | TAGGCCCCGCCGAAGCTGACATCGACTTCGACATCATCCGCAATGACAATGACACCTTCACGG TCAAGTACACGCCCCGGGGGGCTGGCAGCTACACCATTATGGT |
| 4009 | FLNA | 4027235 | CACCCCAACAAGGTCAAAGTATACGGCCCCGGAGTAGCCAAGACAGGGCTCAAGGCCCACG AGCCCACCTACTTCACTGTGGACTGCGCCGAGGCTG |
| 4010 | FLNA | 4027236 | CTGCCCTGTGGAGGCGTTGGTCAAGGACAACGGCAATGGCACTTACAGCTGCTCCTACGTGC CCAGGAAGCCGGTGAAGCACACAGC |
| 4011 | FLNA | 4027238 | AGAAGACAGGTGTGGCCGTCAACAAGCCAGCAGAGTTCACAGTGGATGCCAAGCACGGTGG CAAGGCCCCACTTC |
| 4012 | FLNA | 4027239 | GGCCATCGCAGGCTAAGATCGAATGTGACGACAAGGGCGACGGCTCCTGTGATGTGCGCTAC TGGCCGCAGGAGGCTGGCGAGTATGCCGTTCACGTGCTGTGCAACAGCGAAGACATCCGCC |
| 4013 | FLNA | 4027240 | CACCTGGGGACAGACGATGGCAAGGACGGCCCACCCTG |
| 4014 | FLNA | 4027242 | GGCGTGTATGGCTTCGAGTATTACCCCATGGTCCCTGGAACCTATATCGTCACCATCACGTGG GGTGGTCAGAACAT |
| 4015 | FLNA | 4027243 | CTGTAACCCGAGTGCCTGCCGGGCGGTTGGCCGGGGCCTCCAGCCCAAGGGTGTGCGGGTG AAGGAGACAGCTGACTTCAAGGTGTACACAAAGGGCGCTGGCA |
| 4016 | FLNA | 4027244 | AGGTCGAGGTTGTGATCCAGGACCCCATGGGACAGAAGGGCACGGTAGAGCCTCAGCTGGA GGCCCGGGGCGACAGCACATACCGCTGCAGCTACCAGCCCACCATGGAGGGCGTCCACACC GTGCACGTCACGTTTGCCGGCGTGCC |
| 4017 | FLNA | 4027245 | GCCCCTTCGAGGTGTACGTGGATAAGTCACAGGGTGACGCCAGCAAAGTGACAGCCCAAGG TCCCGGCCTGGAGCCCAGTGGCAACATCGCCAACAAGA |
| 4018 | FLNA | 4027246 | AAAGTGACCGCCAATAACGACAAGAACCGCACCTTCTCCGTCTGGTACGTCCCCGAGGTGA |
| 4019 | FLNA | 4027248 | ACGTGGACGAGCACTCTGTCATGACCTACCTGTCCCAGTTCCCCAAGGCCAAGCTGAAGCCAG GGGCTCCCTTGCGGCCCAAACTGAACCCGAAGAAAGCCCGTGCCTACGGGCCA |
| 4020 | FLNA | 4027250 | TGTGTCCTGACTGGGACTCTTGGGACGCCAGCAAGCCCGTTACCAATGCGCGAGAGGCCATG CAGCAGGCGGATGACTGGCTGGGCATCCCCCA |
| 4021 | FLNA | 4027252 | AGGCCATCGTGGACGGGAACCTGAAGCTGATCCTGGGCCTCATCTGGACCCTGATCCTGCAC TACTCCATCTCCATGCCCATGTGGGACGAGGAGGAGGATGAGGAGGCCAAGAAGCAGACCC CCAAGCAGAGGCTCCTGGGCTGGATCCAGAACAAGCTGCCGCAGCTGCCCATCACCAACTTC AGCCGGGACTGGCA |
| 4022 | FLNA | 4027256 | ATGAGTAGCTCCCACTCTCGGGCGGGCCAGAGCGCAGCAGGCGCGGCTCCGGGCGGCGGCG TCGACACGCGGGACGCCGAGATGCCGGCCACCGAGAAGGACCTGGCCGAGGACGCGCCGT GGAAGAAGATCCAGCAGAACACTTTCACGCGCTGGTGCAACGAGCACCTGAAGTGCGTGAG CAAGCGCATCGCCAACCTGCAGACGGACCTGAGCGACGGGCTGCGGCTTATCGCGCTGTTGG AGGTGCTCAGCCAGAAGAAGATGCACCGCAAGCACAACCAGCGGCCCACTTTCCGCCAAATG CAGCTTGAGAACGTGTCGGTGGCGCTCGAGTTCCTGGACCGCGAGAGCATCAAACTGGTGTC CA |
| 4023 | FLNA | 4027257 | CGCGCGCCTAGGTGCCTGCGACTTTAATTAAAGGGCCGTCCCCTCGCCGAGGCTGCAGCACC GCCCCCCGGCTTCTCGCGCCTCAA |
| 4024 | FLNA | 4027259 | GCGGACGCCGACAGAATCCCCGAGGCGCCTGGCGCGGGCGCGGGCGCGAAGGCGATCCGG GCGCCACCCCGCGGTCATCGGTCACCGGTCGCTCTCAGGAACAGCAG |

TABLE 13-continued

Subtyping Target Sequences

| SEQ ID NO. | Gene | Affy Probeset ID | Sequence |
|---|---|---|---|
| 4025 | KRT18 | 4028791 | CGGCGCCCGGCCGGTCAGCAGCGCGGCCAGCG |
| 4026 | KRT18 | 4028795 | ATGCGCCAGTCTGTGGAGAACGACATCCATGGGCTCCGCAAG |
| 4027 | HLA-DRB5 | 4048242 | TCATCTGTCCACCTGGCTCCAAAGACA |
| 4028 | HLA-DRB5 | 4048243 | GTACTCCCCCTGTGTGCCACAAATGCACTACGTTATTAAATT |
| 4029 | HLA-DRB5 | 4048245 | AGCACAGTCTGAATCTGCACAGAGCAAGATGCTGAGTGGAGTCGGGGGCTTTGTGCTGGGC CTGCTCTTCCTTGGGGCCGGGCTATTCATCTACTTCAAGAATC |
| 4030 | HLA-DRB5 | 4048247 | ATTGAAGTCAGGTGGTTCCGGAACAGCCAGGAAGAGAAGGCTGGGGTGGTGTCCACAGGCC TGATTCAGAATGGAGACTGGACCTTCCAGACCCTGGTGATGCTGGAAACAGTTCCTCGAAGT GGAGAGGTTTACACCTGCCAAGTGGAGCACCCAAGCGTGACGAGCCC |
| 4031 | HLA-DRB5 | 4048248 | ACCCTGCAGCACCACAACCTCCTGGTCTGCTCTGTGAATGGTTTCTATCCAG |
| 4032 | HLA-DRB5 | 4048249 | CTAAGGTGACTGTGTATCCTGCAAGGACCCAG |
| 4033 | HLA-DRB5 | 4048252 | GGTGCGGTTCCTGCACAGAGACATCTATAACCAAGAGGAGGACTTGCGCTTCGACAG |
| 4034 | HLA-DRB5 | 4048253 | GTTTCTTGCAGCAGGATAAGTATGAG |
| 4035 | HLA-DRB5 | 4048256 | ATGGCAAAGCTGACAGTGACACTGA |
| 4036 | HLA-DRB5 | 4048257 | GTGTGTCTGAAGCTCCCTGGAGGTTCCTAC |
| 4037 | HLA-DRB1 | 4048268 | CTGAAGTGCACATGACCACATTCAAGGAAGAACCTTCTGCCACAG |
| 4038 | HLA-DRB1 | 4048272 | AGATGCTGAGTGGAGTCGGGGGCTTTGTGCTGGGCCTGCTCTTCCTTGGGACAGGGCTGTTC ATCTACTTCAGGAATCAG |
| 4039 | HLA-DRB1 | 4048274 | TCAACCACCAAGAAGGGGACTGTGCTAATCCCTGAGC |
| 4040 | HLA-DRB1 | 4048275 | CTGCGGTGGTCTCCATAGGCCTGATCCAGAATGGAGATTGGACCTTCCAGACCCTGGTGATG CTGGAAACAGTTCCTCGGAGTGGAGAGGTTTACACCT |
| 4041 | HLA-DRB1 | 4048276 | CCATCCTAAGGTGACTGTGTATCCTGCAAAG |
| 4042 | HLA-DRB1 | 4048278 | ACTCGCTTCTGTGCCGGCCGCCAGAAGGTTTGCTGAGGGCAATCACTCCCTGGTGCCGGGCTC CTTGAGGTTATGCACTGGGACATCTAGAGCCTATTGTTTGAGGAATGCAGTCTTGCAAGCCTG CTCTGGATCAAGCCACAGACTGAAACACCCCGAAGAGCA |
| 4043 | HLA-DRB1 | 4048279 | TCTGTATTCACCCTGTATGACAAACACA |
| 4044 | HLA-DRB1 | 4048284 | GTGAGTGGTTTCTATCCAGGCAGCATT |
| 4045 | HLA-DRB1 | 4048285 | CTAAGGTGACTGTATATCCTTCAAAG |
| 4046 | HLA-DRB1 | 4048289 | TACTTCTATAACCAGGAGGAGTCCGTG |
| 4047 | HLA-DRB1 | 4048296 | CTGGAGGCTCCTGCATGACAGCGCTGACAGTGACACTGAT |
| 4048 | HLA-DRB1 | 4048297 | GGAGGGGTTCATAGTTCTCCCTGAGTGAGAC |
| 4049 | HLA-DRB1 | 4048299 | GACAAGATGGACGACTACTGCAGATACAATTACGGG |
| 4050 | HLA-DRB1 | 4048301 | GCTAAGTGTGAGTGTCATATCTTCAATGGGATGAAGCGGGTGCAGTACCTGAACAGATACAT CCATAAACGGGAGGAGAACCTGCGCTTCGACAGCAACGTGGAGGAGTTCCAGGCAGTTACG GAACTGGGGCGGCCTGTCGCAGAGAACTGGAACA |

Example 4

Univariate Analysis of a Genomic Subtyping Classifier to Predict Molecular Subtypes in Muscle-Invasive Bladder Cancer Univariate analysis for a genomic subtyping classifier to predict molecular subtypes in muscle-invasive bladder cancer patients was performed. P-values for individual genes in an exemplary Genomic Subtyping Classifier (GSC) were generated to predict four classes of subtypes (claudin-low, basal, luminal-infiltrated and luminal). P-values for the individual genes are shown in Table 14. These results showed that methods of the present invention are useful for predicting molecular subtypes for subject with muscle-invasive bladder cancer. These results suggested that the methods of the present invention may be useful for predicting benefit from neoadjuvant chemotherapy and treating a subject for bladder cancer.

TABLE 14

Univariate Analysis of Genes in Genomic Subtyping Classifier

|  | Luminal-Infiltrated | Luminal | Claudin-Low | Basal |
| --- | --- | --- | --- | --- |
| ACER2 | 0.157 | 0.000 | 0.000 | 0.000 |
| PPARG | 0.124 | 0.000 | 0.000 | 0.000 |
| TMPRSS2 | 0.289 | 0.000 | 0.000 | 0.000 |
| SCNN1B | 0.388 | 0.000 | 0.000 | 0.000 |
| ACOX1 | 0.142 | 0.000 | 0.000 | 0.000 |
| RNF128 | 0.119 | 0.000 | 0.000 | 0.000 |
| UPK2 | 0.107 | 0.000 | 0.000 | 0.000 |
| GRHL3 | 0.185 | 0.000 | 0.000 | 0.000 |
| TIMP2 | 0.020 | 0.000 | 0.000 | 0.126 |
| UPK3A | 0.323 | 0.000 | 0.000 | 0.000 |
| SNX31 | 0.053 | 0.000 | 0.000 | 0.000 |
| TNC | 0.185 | 0.000 | 0.000 | 0.101 |
| TGFBI | 0.100 | 0.000 | 0.000 | 0.139 |
| SULF1 | 0.040 | 0.000 | 0.000 | 0.235 |
| POSTN | 0.071 | 0.000 | 0.000 | 0.101 |
| VIM | 0.008 | 0.000 | 0.000 | 0.392 |
| GATA3 | 0.083 | 0.000 | 0.000 | 0.000 |
| PSCA | 0.119 | 0.000 | 0.000 | 0.001 |
| EFEMP1 | 0.128 | 0.000 | 0.000 | 0.044 |
| FBP1 | 0.137 | 0.000 | 0.001 | 0.000 |
| TMEM45B | 0.449 | 0.000 | 0.000 | 0.002 |
| MT1L | 0.742 | 0.000 | 0.000 | 0.080 |
| HPGD | 0.350 | 0.000 | 0.000 | 0.041 |
| DHRS2 | 0.032 | 0.000 | 0.000 | 0.000 |
| DCN | 0.011 | 0.000 | 0.001 | 0.107 |
| IFITM2 | 0.993 | 0.000 | 0.000 | 0.015 |
| CALD1 | 0.032 | 0.000 | 0.000 | 0.622 |
| BAMBI | 0.007 | 0.000 | 0.001 | 0.000 |
| TPM2 | 0.038 | 0.000 | 0.000 | 0.227 |
| ERBB2 | 0.209 | 0.000 | 0.000 | 0.000 |
| GBP5 | 0.810 | 0.000 | 0.000 | 0.008 |
| LAPTM5 | 0.132 | 0.000 | 0.001 | 0.064 |
| TBX3 | 0.100 | 0.000 | 0.000 | 0.001 |
| SEMA5A | 0.027 | 0.000 | 0.005 | 0.000 |
| EHF | 0.689 | 0.000 | 0.000 | 0.009 |
| LAMC2 | 0.168 | 0.000 | 0.000 | 0.309 |
| GSTM3 | 0.060 | 0.000 | 0.000 | 0.001 |
| IFI30 | 0.637 | 0.000 | 0.000 | 0.027 |
| HLA-DRA | 0.341 | 0.000 | 0.005 | 0.012 |
| ATP8B1 | 0.728 | 0.000 | 0.003 | 0.002 |
| SNCG | 0.012 | 0.000 | 0.000 | 0.000 |
| S100P | 0.428 | 0.000 | 0.000 | 0.042 |
| MYL9 | 0.016 | 0.000 | 0.000 | 0.314 |
| KRT5 | 0.236 | 0.000 | 0.005 | 0.000 |
| SNAI2 | 0.742 | 0.000 | 0.000 | 0.126 |
| SPINK1 | 0.051 | 0.000 | 0.001 | 0.000 |
| TOX3 | 0.439 | 0.000 | 0.000 | 0.015 |
| TIMP1 | 0.033 | 0.000 | 0.000 | 0.896 |
| BGN | 0.020 | 0.000 | 0.000 | 0.740 |
| COL1A2 | 0.060 | 0.000 | 0.000 | 0.493 |
| TWIST2 | 0.179 | 0.000 | 0.000 | 0.286 |
| VCAN | 0.033 | 0.000 | 0.000 | 0.658 |
| PVRL4 | 0.460 | 0.000 | 0.001 | 0.011 |
| ZNF91 | 0.119 | 0.000 | 0.014 | 0.000 |
| RALBP1 | 0.482 | 0.000 | 0.275 | 0.000 |
| ASPN | 0.179 | 0.000 | 0.037 | 0.021 |
| COL3A1 | 0.045 | 0.000 | 0.000 | 0.586 |
| LUM | 0.009 | 0.000 | 0.000 | 0.763 |
| SFRP2 | 0.203 | 0.000 | 0.000 | 0.928 |
| SLC14A1 | 0.369 | 0.000 | 0.009 | 0.002 |
| G0S2 | 0.922 | 0.000 | 0.000 | 0.375 |
| CYP4Z2P | 0.428 | 0.000 | 0.000 | 0.309 |
| SCCPDH | 0.551 | 0.000 | 0.001 | 0.023 |
| ELF3 | 0.624 | 0.000 | 0.000 | 0.053 |
| SYTL2 | 0.637 | 0.000 | 0.005 | 0.056 |
| KRT18 | 0.142 | 0.000 | 0.716 | 0.000 |
| CTSK | 0.036 | 0.000 | 0.000 | 0.615 |
| GABRP | 0.068 | 0.015 | 0.494 | 0.000 |
| AHR | 0.676 | 0.000 | 0.033 | 0.004 |
| UGT1A4 | 0.587 | 0.001 | 0.000 | 0.687 |
| MMP1 | 0.040 | 0.001 | 0.000 | 0.177 |
| UGT1A5 | 0.428 | 0.002 | 0.000 | 0.724 |
| ITGA6 | 0.880 | 0.001 | 0.000 | 0.856 |
| CD74 | 0.258 | 0.000 | 0.013 | 0.112 |
| ACTG2 | 0.017 | 0.000 | 0.000 | 0.968 |
| CD68 | 0.398 | 0.000 | 0.001 | 0.339 |
| PLP2 | 0.702 | 0.008 | 0.000 | 0.825 |
| KRT8 | 0.439 | 0.000 | 0.829 | 0.000 |
| UGT1A3 | 0.527 | 0.002 | 0.000 | 0.672 |
| AHNAK | 0.715 | 0.007 | 0.000 | 0.559 |
| TNFRSF21 | 0.493 | 0.000 | 0.005 | 0.023 |
| UGT1A10 | 0.408 | 0.007 | 0.000 | 0.880 |
| UPK1B | 0.032 | 0.000 | 0.001 | 0.008 |
| GBP1 | 0.796 | 0.000 | 0.000 | 0.156 |
| SAMD9 | 0.024 | 0.000 | 0.002 | 0.004 |
| OLFM4 | 0.243 | 0.022 | 0.352 | 0.000 |
| CCL5 | 0.769 | 0.000 | 0.006 | 0.042 |
| HLA-DRB5 | 0.323 | 0.000 | 0.119 | 0.023 |
| UGT1A1 | 0.637 | 0.002 | 0.000 | 0.672 |
| RNF138P1 | 0.539 | 0.000 | 0.001 | 0.095 |
| MMP12 | 0.076 | 0.000 | 0.067 | 0.000 |
| CFH | 0.243 | 0.000 | 0.002 | 0.420 |
| MAL | 0.216 | 0.000 | 0.006 | 0.013 |
| SAA1 | 0.191 | 0.000 | 0.001 | 0.034 |
| ADAM10 | 0.236 | 0.000 | 0.081 | 0.001 |
| PTPRM | 0.065 | 0.000 | 0.014 | 0.003 |
| FGFBP1 | 0.015 | 0.001 | 0.111 | 0.000 |
| ZNF486 | 0.041 | 0.000 | 0.030 | 0.001 |
| UGT1A8 | 0.369 | 0.006 | 0.000 | 0.615 |
| MMP2 | 0.031 | 0.000 | 0.000 | 0.786 |
| KRT7 | 0.378 | 0.000 | 0.189 | 0.002 |
| PAQR7 | 0.350 | 0.000 | 0.048 | 0.009 |
| C3 | 0.179 | 0.000 | 0.047 | 0.190 |
| DSP | 0.258 | 0.000 | 0.015 | 0.018 |
| THBS2 | 0.031 | 0.001 | 0.000 | 0.687 |
| CASP14 | 0.323 | 0.001 | 0.128 | 0.003 |
| KRT23 | 0.471 | 0.014 | 0.001 | 0.786 |

TABLE 14-continued

Univariate Analysis of Genes in Genomic Subtyping Classifier

|  | Luminal-Infiltrated | Luminal | Claudin-Low | Basal |
|---|---|---|---|---|
| STS | 0.223 | 0.001 | 0.065 | 0.006 |
| DDIT4 | 0.894 | 0.001 | 0.083 | 0.040 |
| HLA-A | 0.482 | 0.001 | 0.048 | 0.019 |
| AGR2 | 0.993 | 0.001 | 0.004 | 0.309 |
| IER3 | 0.922 | 0.001 | 0.005 | 0.300 |
| ANXA1 | 0.516 | 0.013 | 0.002 | 0.650 |
| NQO1 | 0.689 | 0.002 | 0.122 | 0.023 |
| SERPINB3 | 0.243 | 0.002 | 0.185 | 0.004 |
| CRISP3 | 0.060 | 0.002 | 0.007 | 1.000 |
| BTBD16 | 0.306 | 0.011 | 0.002 | 0.420 |
| GJB2 | 0.428 | 0.078 | 0.002 | 0.904 |
| CXCL17 | 0.702 | 0.127 | 0.003 | 0.319 |
| TACSTD2 | 0.922 | 0.003 | 0.275 | 0.027 |
| LYZ | 0.408 | 0.003 | 0.077 | 0.219 |
| SAT1 | 0.504 | 0.005 | 0.004 | 0.304 |
| IGFBP3 | 0.323 | 0.005 | 0.009 | 0.144 |
| TMSB10 | 0.993 | 0.006 | 0.007 | 0.462 |
| EPCAM | 0.964 | 0.009 | 0.956 | 0.007 |
| GSTM2 | 0.332 | 0.023 | 0.007 | 0.432 |
| MALL | 0.119 | 0.007 | 0.151 | 0.010 |
| MACC1 | 0.033 | 0.008 | 0.027 | 0.856 |
| FLRT3 | 0.009 | 0.200 | 0.040 | 0.231 |
| MUC16 | 0.439 | 0.009 | 0.128 | 0.047 |
| SPARCL1 | 0.010 | 0.029 | 0.022 | 0.329 |
| MYH11 | 0.011 | 0.072 | 0.012 | 0.118 |
| DUSP1 | 0.689 | 0.017 | 0.011 | 0.475 |
| CLDN1 | 0.323 | 0.016 | 0.427 | 0.012 |
| TIMP3 | 0.027 | 0.026 | 0.013 | 0.375 |
| MGP | 0.014 | 0.014 | 0.239 | 0.778 |
| PTN | 0.020 | 0.200 | 0.763 | 0.014 |
| IGFL1 | 0.223 | 0.021 | 0.158 | 0.044 |
| MMP13 | 0.173 | 0.030 | 0.292 | 0.025 |
| CGB2 | 0.428 | 0.181 | 0.030 | 0.904 |
| CPSF6 | 1.000 | 0.040 | 0.211 | 0.235 |
| SPP1 | 0.273 | 0.040 | 0.510 | 0.295 |
| LRRC37A2 | 0.715 | 0.056 | 0.057 | 0.475 |
| SPRR2F | 0.289 | 0.070 | 0.609 | 0.076 |
| PLXNB2 | 0.637 | 0.072 | 0.309 | 0.403 |
| TPX2 | 0.185 | 0.528 | 0.108 | 0.904 |
| HIST1H2BF | 0.852 | 0.656 | 0.134 | 0.397 |
| RARRES1 | 0.676 | 0.781 | 0.202 | 0.622 |
| NDRG1 | 0.428 | 0.725 | 0.230 | 0.888 |

Example 5

Molecular Subtypes in Muscle-Invasive Bladder Cancer

Tables 15 and 16 show subsets of markers based on the scores from Table 10.

TABLE 15

|  | Claudin-low | Basal | Luminal | Luminal-infiltrated |
|---|---|---|---|---|
| Score ≥0.75 | LAMC2; IFI30; SAA1; VIM; TGFBI | TMEM45A; GABRP | PTPRM |  |
| Score ≥0.5 | LAMC2; IFI30; SAA1; VIM; TGFBI; TIMP2; GBP1; SNAI2 | TMEM45A; GABRP; EFEMP1 | PTPRM; CPSF6; PTPN13; VGLL1; ELF3 | SNCG |
| Score ≥0.25 | LAMC2; IFI30; SAA1; VIM; TGFBI; TIMP2; GBP1; SNAI2; GBP5; POSTN; TNC; F3; BGN | TMEM45A; GABRP; EFEMP1; HIST1H2BF; IFI16; MALL; MMP12; SPRR1B; TGM2; TPX2 | PTPRM; CPSF6; PTPN13; VGLL1; ELF3; ACER2; ACOX1; CDH1; F11R; PPARG; RNF128; SCCPDH; SFN; STS; TACSTD2; TMEM45B | SNCG; AHR; INA; PM20D1; GRHL3 |
| Score ≥0.1 | LAMC2; IFI30; SAA1; VIM; TGFBI; TIMP2; GBP1; SNAI2; GBP5; POSTN; TNC; F3; BGN; CCL5; SULF1; WARS; MMP3; CXCL10; TIMP3; SERPINB1; DDIT4 | TMEM45A; GABRP; EFEMP1; HIST1H2BF; IFI16; MALL; MMP12; SPRR1B; TGM2; TPX2; CLDN1; GOS2; IFITM2; PTMS | PTPRM; CPSF6; PTPN13; VGLL1; ELF3; ACER2; ACOX1; CDH1; F11R; PPARG; RNF128; SCCPDH; SFN; STS; TACSTD2; TMEM45B; BTG2; GRHL1; IFI6; RALBP1; IGFBP3 | SNCG; AHR; INA; PM20D1; GRHL3; ACTA2; ACTG2; CYP1A1; DUSP1; HLA-DRB5; MAL; SPINK1; UPK1A |

TABLE 16

| Score ≥0.75 | Score ≥0.5 | Score ≥0.25 | Score ≥0.1 |
|---|---|---|---|
| LAMC2; IFI30; SAA1; VIM; TGFBI; TMEM45A; GABRP; PTPRM | LAMC2; IFI30; SAA1; VIM; TGFBI; TIMP2; GBP1; SNAI2; TMEM45A; GABRP; EFEMP1; PTPRM; CPSF6; PTPN13; VGLL1; ELF3; SNCG | LAMC2; IFI30; SAA1; VIM; TGFBI; TIMP2; GBP1; SNAI2; GBP5; POSTN; TNC; F3; BGN; TMEM45A; GABRP; EFEMP1; HIST1H2BF; IFI16; MALL; MMP12; SPRR1B; TGM2; TPX2; PTPRM; CPSF6; PTPN13; VGLL1; ELF3; ACER2; ACOX1; CDH1; F11R; PPARG; RNF128; SCCPDH; SFN; STS; TACSTD2; TMEM45B; SNCG; AHR; INA; PM20D1; GRHL3 | LAMC2; IFI30; SAA1; VIM; TGFBI; TIMP2; GBP1; SNAI2; GBP5; POSTN; TNC; F3; BGN; CCL5; SULF1; WARS; MMP3; CXCL10; TIMP3; SERPINB1; DDIT4; TMEM45A; GABRP; EFEMP1; HIST1H2BF; IFI16; MALL; MMP12; SPRR1B; TGM2; TPX2; CLDN1; GOS2; IFITM2; PTMS; PTPRM; CPSF6; PTPN13; VGLL1; ELF3; ACER2; ACOX1; CDH1; F11R; PPARG; RNF128; SCCPDH; SFN; STS; TACSTD2; TMEM45B; BTG2; GRHL1; IFI6; RALBP1; IGFBP3; SNCG; AHR; INA; PM20D1; GRHL3; ACTA2; ACTG2; CYP1A1; DUSP1; HLA-DRB5; MAL; SPINK1; UPK1A |

Although the invention has been described with reference to the above examples, it will be understood that modifications and variations are encompassed within the spirit and scope of the invention, Accordingly, the invention is limited only by the following claims.

SEQUENCE LISTING (4050 sequences)

SEQ ID NO: 1 - DNA, 120 bp, Homo sapiens
tgggaacctacctgtcagcaaaatctcgacacccaaacctcaacataaatcaaacactttcccgggcagagaatgtctgtgtcaggcaagaattagagacaagcggtcagcagagcctca

SEQ ID NO: 2 - DNA, 153 bp, Homo sapiens
acatcggtggatacctgccgctctcagagcgtggaggctggatggggtttcctggagggggaagagcggggaggccggcaccgggattcacagagcaatttgtaagggtaaatgaatgggctgacgatcttactttggcgtgtcaaggcaagc

SEQ ID NO: 3 - DNA, 46 bp, Homo sapiens
aggagatgtgccaaactgttaagagtggttatttctgagcagaaga

SEQ ID NO: 4 - DNA, 31 bp, Homo sapiens
atgtggatgaattccattcttcctatttttc

SEQ ID NO: 5 - DNA, 104 bp, Homo sapiens
tgtgcggctgctaaagaacgacccagtcaacttgcagaaattctcttacactagtgaggatgaggcctggaagacgtacctagaaaacccgttgacagctgcca

SEQ ID NO: 6 - DNA, 48 bp, Homo sapiens
gagatgatgacagtgttgcggccttgagcttcctctatgattactaca

SEQ ID NO: 7 - DNA, 30 bp, Homo sapiens
gagaagcggatattgtcctccagcactggg

SEQ ID NO: 8 - DNA, 44 bp, Homo sapiens
tgagacggacctcactccccttgaaagccccacacacctcatga

SEQ ID NO: 9 - DNA, 197 bp, Homo sapiens
tcaagaagaataacctgatgagcttggagggggccttgcccacccctggcaaggcagctcccctccctgcaggccccagcaagctggaggccggctctgtggacagctacctgttacccaccactgatatgtatgataatggctccctcaactccttgtttgagagcattcatggggtgccgcccacacagcgctgg

SEQ ID NO: 10 - DNA, 26 bp, Homo sapiens
agcaagtctgtaacatagcctcaggc

SEQ ID NO: 11 - DNA, 74 bp, Homo sapiens
tgactttgaatacaccctgggctcccccaaagccatccacatcaagtcaggcgagtcacccatggcctacctca

SEQ ID NO: 12 - DNA, 108 bp, Homo sapiens
agtgtggtgatggttgtcttcgacaatgagaaggtcccagtagagcagctgcgcttctggaagcactggcattcccggcaacccactgccaagcagcgggtcattgac

SEQ ID NO: 13 - DNA, 60 bp, Homo sapiens
aagaaaacttcaacactgtggagcacattgaggaggtggcctataatgcactgtcctttg

SEQ ID NO: 14 - DNA, 151 bp, Homo sapiens
gtgttcatcggcgtaaactgtctgagcacagacttttcctcacaaaagggggtgaagggtgtccccctgaacctgcagattgacacctatgactgtggcttgggcactgagcgcctggtacaccgtgctgtctgccagatcaagatcttct

SEQ ID NO: 15 - DNA, 48 bp, Homo sapiens
aggaagatgcgcgatgacgagcggaagcagttccggaggaaggtcaag

SEQ ID NO: 16 - DNA, 100 bp, Homo sapiens
caatgagacgacctaccttcggccagagactgacctggagacgccacccgtgctgttcatccccaatgtgcacttctccagcctgcagcgctctggaggg

SEQ ID NO: 17 - DNA, 145 bp, Homo sapiens
tcagccagtttcaagacctttattgaatcataggggtttaaacatgtatatatggtcctatagcttcagtgacctattgtattgaagagaagaatgttatgaagaaacagatttcgtaaccattaaaacgttcatgcttagggca

SEQ ID NO: 18 - DNA, 60 bp, Homo sapiens
ttctgctgtatgtgcggagggagactgaggaggtgtttgacgcgctcatgttgaagaccc

SEQ ID NO: 19 - DNA, 101 bp, Homo sapiens
cttagtcaacatggacaacaacatcattcagcattacagcaaccacgtcgccttcctgctggacatgggggagctggacggcaaaattcagatcatcctta

SEQ ID NO: 20 - DNA, 533 bp, Homo sapiens
gcctcagcgctgttacttgaatgccttccctgagggaagaggcccttgagtcacagacccacagacgtcagggccagggagagacctagggggtcccctggcctggatccccatggtatgcttgaatctgctccctgaacttcctgccagtgcctccccgtaccccaaaacaatgtcaccatggttaccacctacccagaagactgttccctcctcccaagacccttgtctgcagtggtgctcctgcaggctgcccgttaagatggtggcggcacacgctccctcccgcagcaccacgccagctggtgcggcccccactctctgtcttccttcaacttcagacaaaggatttctcaacctttggtcagttaacttgaaaactcttgattttcagtgcaaatgacttttaaaagacactatattggagtctctttctcagacttcctcagcgcaggatgtaaatagcactaacgatcgactggaacaaagtgaccgctgtgtaaaactactgccttgccactcactgttgtata

SEQ ID NO: 21 - DNA, 219 bp, Homo sapiens
cacctgactgtcttgaatgttcccatcctgtgactcaagtgaggaacatgggttttggagatggattttggaggcagagggacctggattcaaatcccagccccaccaccgtcaacagcctgcacttcactgtaaactcggaatgacacacccacctggaggagaggtggaaggacgacggcaggtcacatctgagagctctcagctcagagtatgtgg

SEQ ID NO: 22 - DNA, 51 bp, Homo sapiens
agagacacagagtccggcattggtcccaggcagcagttagcccgccgcccg

SEQ ID NO: 23 - DNA, 113 bp, Homo sapiens
cgctatgaggacatggcagccttcatgaaaggcgccgtggagaagggcgaggagctctcctgcgaagagcgaaacctgctctcagtagcctataagaacgtggtgggcggcca

SEQ ID NO: 24 - DNA, 35 bp, Homo sapiens
agctccagggcgtgtgcgacaccgtgctgggcctg

SEQ ID NO: 25 - DNA, 246 bp, Homo sapiens
caccggtgacgacaagaagcgcatcattgactcagcccggtcagcctaccaggaggccatggacatcagcaagaaggagatgccgcccaccaaccccatccgcctgggcctggccctgaacttttccgtcttccactacgagatcgccaacagccccgaggaggccatctctctggccaagaccactttcgacgaggccatggctgatctgcacaccctcagcgaggactcctacaaagacagcac

SEQ ID NO: 26 - DNA, 292 bp, Homo sapiens
accctgccgagaggactagtatggggtgggaggccccacccttctcccctaggcgctgttcttgctccaaagggctccgtggagagggactggcagagctgaggccacctggggctggggatcccactcttcttgcagctgttgagcgcacctaaccactggtcatgcccccacccctgctctccgcacccgcttcctcccgaccccaggaccaggctacttctcccctcctcttgcctccctcctgcccctgctgcctctgatcgtaggaattgaggagtgtcccgccttg

SEQ ID NO: 27 - DNA, 49 bp, Homo sapiens
tgcgcgcgcgccagtgcaagaccgagattgagggaaagcatgtctgctg

SEQ ID NO: 28 - DNA, 70 bp, Homo sapiens
tcctggcttcaggaactcatggctcaccccttcttgctgctgatcctcctctgcatgtctctgctgctgt

SEQ ID NO: 29 - DNA, 32 bp, Homo sapiens
cttgtgggttggaccctttacgatgttcttca

SEQ ID NO: 30 - DNA, 102 bp, Homo sapiens
cgaggacttgtgaccctggatggttctaaatggaaaaagcaccgccagattgtgaaacctggcttcaacatcagcattctgaaaatattcatcaccatgatg

SEQ ID NO: 31 - DNA, 62 bp, Homo sapiens
tgggaggaacacattgcccaaaactcacgtctggagctctttcaacatgtctccctgatgac

SEQ ID NO: 32 - DNA, 123 bp, Homo sapiens
ccctggactcatacctgaaagcagtgttcaaccttagcaaaatctccaaccagcgcatgaacaattttctacatcacaacgacctggttttcaaattcagctctcaaggccaaatcttttcta

SEQ ID NO: 33 - DNA, 56 bp, Homo sapiens
agtaatccaggaccggaaggagtctcttaaggataagctaaaacaagatactactc

SEQ ID NO: 34 - DNA, 31 bp, Homo sapiens
atgtgcatcaaggaatgcctccgcctctacg

SEQ ID NO: 35 - DNA, 28 bp, Homo sapiens
tagtaaacatatcccggttactcgacaa

SEQ ID NO: 36 - DNA, 25 bp, Homo sapiens
ctgtgtttatcaatatttgggctct

SEQ ID NO: 37 - DNA, 43 bp, Homo sapiens
ttcatcaggagttccttcaaagatgtggaccatctatttcaaa

SEQ ID NO: 38 - DNA, 96 bp, Homo sapiens
agagatccacatgacaggcccaatgtgcctcattgagaacactaatgggcgactgatggcgaatccagaagctctgaagatcctttctgccattac

SEQ ID NO: 39 - DNA, 92 bp, Homo sapiens
gtgcagtctcacactaaaggaatctggatgtggtgtatgccccatcccaagaagccaggccacatcctagttctgctggacaccgagggtct

SEQ ID NO: 40 - DNA, 27 bp, Homo sapiens
gacaaacaggaacacctgcttacagcc

SEQ ID NO: 41 - DNA, 61 bp, Homo sapiens
cagacatacttgaaatccaaggagtctatgactgatgcaattctccagacagaccagactc

SEQ ID NO: 42 - DNA, 184 bp, Homo sapiens
gaaagctgagtctgcacaggcttcagcaaaaatgttgcagcaaatgcaaagaaagaatgagcagatgatggaacagaaggagaggagttatcaggaacacttgaaacaactgactgagaagatggagagcgacagggtccagttgctggaagagcaagagaggaccctcgctcttaaacttcag

SEQ ID NO: 43 - DNA, 68 bp, Homo sapiens
tctgggcctctcacaaacgctgagccccgccccgctgaggcctgtctgcagaatccacagcaaccagc

SEQ ID NO: 44 - DNA, 32 bp, Homo sapiens
gtaatggcaccctcgagtctgggccctgcccc

SEQ ID NO: 45 - DNA, 37 bp, Homo sapiens
cccgtctgggtaattatgatgggtgtccctcagggct

SEQ ID NO: 46 - DNA, 53 bp, Homo sapiens
ctcctgattatgacagaagccagtggctgaatgaaaaattcaagctgggcctg

SEQ ID NO: 47 - DNA, 26 bp, Homo sapiens
ggtacattgcccgcaagcacaacctg

SEQ ID NO: 48 - DNA, 81 bp, Homo sapiens
agcagattcgcgaagacattttggagaaccagtttatggacagccgtatgcagctggccaaactctgctatgacccagatt

SEQ ID NO: 49 - DNA, 401 bp, Homo sapiens
cctttccctgcagagtttgtgtccaaaattgattccttctggtgagttcttggtcttgctgactctaagaatgaagccgcggtcctacacggtgagtgttacagttcttaaagatggtgtgtccggagtttgttccttcagatgttcagatgtgtccgcagtttcttccttccggtgggtttgtggtcttgctgacttcaggggtgaagccgcagaccttcgcagtgagtgctacagctcttaaaggtggcgcgtctggagttgtttattcctcttggtgggttcatggtctggctggcttcaggagtgaagctgcagaccttcatagtgaatgttatagctcataaaggtagttcaaacccaaagagtgagcaacagcaggatttatggtgacgagtgaa

SEQ ID NO: 50 - DNA, 27 bp, Homo sapiens
gagaaactgaaaccagaatacctgcag

SEQ ID NO: 51 - DNA, 33 bp, Homo sapiens
ggatttcatcgcttatgatgtccttgagagaaa

SEQ ID NO: 52 - DNA, 25 bp, Homo sapiens
ctcccaagacctgtgttcacaaaga

SEQ ID NO: 53 - DNA, 162 bp, Homo sapiens
ccttcctgttagtggttgtgtctgctttaaagggcctgcctggcccctcgcctgtggagctcagccccgagctgtccccgtgttgcatgaaggagcagcattgactggtttacaggccctgctcctgcagcatggtccctgccttaggcctacctgatggaa

SEQ ID NO: 54 - DNA, 2656 bp, Homo sapiens
gtctctgatgattacgctcaaggtattctccttcatatgttagcttttgagaatgcgaaccatgagtgtaaagtggtcatgcgttctgtctaatgacaaaatttacctgatcacgaggtgtgcctgcatatattaaagcttgtgaaagcattggatcagagacccacaaagctattctgtgggcacgggccatgaaggatggcaatcaaactggcttgactgaattcttttcttggagcctgctataattgtggtcaacttcatcatacccaaaaaaattgcactgttaaaagcggccaagccagctcaacaaacatggccaaatgctcctgctactgtttgccctcattgtcgtaaaggtaaacactgggcaagtacttgccactctaagtctgatatagatggcaatcccttgccacagaaccagggaaatgggaagcagggccagtcccaggccccagtatcaaatgggacacctcagactcagaccaatattgtgtttctgcttcaagcggtcccaatacagcccccagcacaagcaaatttacctacagccaacccagatgggtcccagtcgcttcttctgtctcagtacaatgcttgtctacctccacagtagggggcagggcggtcaatctctgtagtaccactcctctaaatttactaccgaattctttgcctttaattgtccccacgggggccactggccctttacctcaaggtttggtgggcctggtgttaggtagggcatccacctctgctaaaggtatcatagttcatactggtctcattaattctgattcctctgatgagattaaaataatcgtgtctgccaaggttcctgtttccattccggccagtgagtcaattgctcaactacttttactacctaatattgttttaaacaaaggagataagacagggggccctgggatgggctctggcggtgaaaaagccgcttattggattaaagtaatttctaaacaacagcccacctgcaccatacatattaaaggaaaaaagtttgagggcctagtagatactggggctgatgtttctattatttcctctaatttatggccttcttcctggcttaaacatcccactaacatgggactagtaagggttggaaaagctgatgaagttcaccaaagcacatttatcttgccttgcactgggcctgatggtcaaaagggaacaattcagccttatatcatgccaatccccattaatctttggggtagatatttgctggaacaatggggggctgaaattaatattccacataactcttctcgtgctcccagtcaacatataatggaaaacgtggggactgttcctggactcagtctcggtccaaaacatgaaggaattactaaattcctttatggtttaaaagcataatttaaccactccccactcccaattccatttagcattgtttactttaaactttctaaatgttcctaaagacaatactctgactgcagccgaacaccattatacaggcaaaaaattctccctaaatgaaagcaagccagtgttatggaaaaactcccagacaaatacctgggaacctggaacaattataatgtggggaagagggtatgcttgtgtttcaccaggagatcatcaatcccctgtctgggtgcccactagaagactttaacttcgtgtgaatactgacaatgaaaaacacagggaagagatgtccacgtcagagactgccctcatacctggtgagatctgtgccaactcctcaaaaactggcacaccaaatcaaaatggatctcattcaatcctccctaatggcaacagagacccctctaactaatcccacttctcctaattacctttctttttctccttacaaacctgaaaatctcaccatttctattagcctgaaaataacatccctctgttcttctcttcctccttcagcactggatctcgcttacaataggttttatttaataattctactccttatactttctgtctcaccagtttcccctcacactgatttgcctgctacacaaaattattcttattgggcttatgtgccttttcctccacttattcgacctctcacctggatgaatgctcctgcggaaatctacactaacgatagtgtgtagatgcctggagctatagatgaccattgccctgctcaaccaggagaagaaggcactgcatttaatgttactatgggttataaataccctcctctgtgcctcggacatgcaactcgttgtatccatctagaaactcaagtctgggctgcttatcttctggagagattagctacaggaaaatggggacatttggtctccggcctctccctttgtcctttaagacaaatgaaaaggggagtaataggagataccccatactttcaatataaacctgtaggaaaactatgtcctaaaaattttgagggcccatctaaaactttaatttggggagattgtgttaactcacatgcagtagtattaaaaaatgactcatatgctttagtaatagactgggcaccaaagggctatttaaaaaacacttgctcctctgggggaggggaattcctggaggctacttattttatttcttattgggaggacgaggatcatcatcctactttgcataggtggttcggctcatt

SEQ ID NO: 55 - DNA, 63 bp, Homo sapiens
gaatctggatactgtgtgccggaccagccaaagaatcctgtgtcaaaaccgagagaacgaata

SEQ ID NO: 56 - DNA, 45 bp, Homo sapiens
agccctgctcggtttaggcctgtctgcggaatccgcaccaaccag

SEQ ID NO: 57 - DNA, 33 bp, Homo sapiens
tgcccatgatactggggtactgggacatccgcg

SEQ ID NO: 58 - DNA, 33 bp, Homo sapiens
ccctccatctctgacgcgacctgcgggccatct

SEQ ID NO: 59 - DNA, 27 bp, Homo sapiens
tggaatacacagactcaagctatgagg

SEQ ID NO: 60 - DNA, 36 bp, Homo sapiens
gtaatggcaccctcgtgttcgggctctgcccactca

SEQ ID NO: 61 - DNA, 33 bp, Homo sapiens
tgctggagctgcaggctgtctcttccctgagcc

SEQ ID NO: 62 - DNA, 147 bp, Homo sapiens
aaagtgcaacgtgtctctgactgcatctcctctccccagcttagaggtgttaagatcaggagtcttctgcccaattcctctcactcctggctgtctaaacagtccttccatgatgttctgtgtccacctgcattcgttcatgtgaca

SEQ ID NO: 63 - DNA, 45 bp, Homo sapiens
agcctggtggcccaactgagcttcgccggtttcccatccatccag

SEQ ID NO: 64 - DNA, 43 bp, Homo sapiens
catggacaaccatatgcagctgggcatgatctgctacaatcca

SEQ ID NO: 65 - DNA, 35 bp, Homo sapiens
aaactgaagccaaagtacttggaggaactccctga

SEQ ID NO: 66 - DNA, 29 bp, Homo sapiens
ctcgtctatgatgtccttgacctccaccg

SEQ ID NO: 67 - DNA, 43 bp, Homo sapiens
ctcccaagacctgtgttctcaaagatggctgtctggggcaaca

SEQ ID NO: 68 - DNA, 125 bp, Homo sapiens
gagtgaggagcccatactcagcctgctgcccaggctgtgcagcgcagctggactctgcatcccagcacctgcctcctcgttcctttctcctgtttattcccatctttactcccaagacttcattg

SEQ ID NO: 69 - DNA, 162 bp, Homo sapiens; identical to SEQ ID NO: 53

SEQ ID NO: 70 - DNA, 42 bp, Homo sapiens
ccagttctaagggaccatacagagtattcctctcttcacacc

SEQ ID NO: 71 - DNA, 27 bp, Homo sapiens
cccaccccctcagcttcagcagcagca

SEQ ID NO: 72 - DNA, 54 bp, Homo sapiens
cccaaagtgcccgagccctgccagcccaaggttccagagccatgccaccccaag

SEQ ID NO: 73 - DNA, 35 bp, Homo sapiens
tgagccctgcccttcaatagtcactccagcaccag

SEQ ID NO: 74 - DNA, 197 bp, Homo sapiens
gcgtatgagtcccatttgccttgcaattagcattctgtctcccccaaaaaagaatgtgctatgaagctttctttcctacacactctgagtctctgaatgaagctgaaggtcttagtaccagagctagttttcagctgctcagaattcatctgaagagagacttaagatgaaagcaaatgattcagctcccttatacc

SEQ ID NO: 75 - DNA, 119 bp, Homo sapiens
gagcaacactcaagctgagaggtccataataggcatgatcgacatgtttcacaaatacaccggacgtgatggcaagattgagaagccaagcctgctgacgatgatgaaggagaacttcc

SEQ ID NO: 76 - DNA, 178 bp, Homo sapiens
ccaagtcttgactgagaaacggaccgggcagatgagggactcccacatatacctgtttcctgctcttcccgaagacattttgccacaagcatataattcagcttctgaaaaatacggtcttcctcactgcagacaccatgccagcgttttaaatcaagttggctactcgtgctgttta

SEQ ID NO: 77 - DNA, 91 bp, Homo sapiens
agtatgcagtttgcctgtggcaatattaaactcatctggaagaaagcacttaaacctatccagttcctcatcggtgatgttatccaggctg

SEQ ID NO: 78 - DNA, 105 bp, Homo sapiens
gttagcaagagtatctccttatatttactctccatctcacgacttttcagcttataagggatccaaactatgtaagattataccaccaaaagtgattcaacattc

SEQ ID NO: 79 - DNA, 31 bp, Homo sapiens
cacgctaaagggcacccactgtccttaacag

SEQ ID NO: 80 - DNA, 89 bp, Homo sapiens
ctaccggaagttcagtgcattttccaggattttcaagtcttcgatgctgtcatgttgagagtccactatccacgtttgtttatccagga

SEQ ID NO: 81 - DNA, 69 bp, Homo sapiens
tggggcaatagcagaataggagcaagccagcactagtcagctaactaagtgactcaaccaaggcctttt

SEQ ID NO: 82 - DNA, 103 bp, Homo sapiens
ttcttagcgtttctggagattacaacatcctgcggttccgtttctgggaactttactgatttatctcccccctcacacaaataagcattgattcctgcatttc

SEQ ID NO: 83 - DNA, 63 bp, Homo sapiens
tctactaaaaggattagaggtcatcaatgattatcattttagaatggttaagtccttactgag

SEQ ID NO: 84 - DNA, 36 bp, Homo sapiens
attttcgaagatataccaacgcttgaagacctggct

SEQ ID NO: 85 - DNA, 107 bp, Homo sapiens
tgctggtctccttaaggccaggctgggctaatgcagtagagctagactaaagcacagctgaaccctcaagcaggaactgagagcaaattgtattgaaactgcttcag

SEQ ID NO: 86 - DNA, 29 bp, Homo sapiens
ctgtcggagatcgtttatatgtcttcctt

SEQ ID NO: 87 - DNA, 29 bp, Homo sapiens
ctccacaagcagcactgtcaaaactgaag

SEQ ID NO: 88 - DNA, 96 bp, Homo sapiens
aaggtgtccgaggaacagactcagcctccctctcctgcaggagccggcatgtccacagccatgggccgttccccatctcccaagacctcattgtca

SEQ ID NO: 89 - DNA, 88 bp, Homo sapiens
acccgaaaacagtggccaaatgtcaggtaactcccagaagaaatgttctccaaaaacgcccagtgatagtgaaggtactgagtacaac

SEQ ID NO: 90 - DNA, 121 bp, Homo sapiens
accacaatctacgaaattcaggatgatagaggaaaaatggatgtagtggggacaggacaatgtcacaatatcccctgtgaagaaggagataagctccaacttttctgctttcgacttagaa

SEQ ID NO: 91 - DNA, 58 bp, Homo sapiens
cccaagagcatgaagctaccccaggaacagcgtcagcttccatatccttcagaggcca

SEQ ID NO: 92 - DNA, 114 bp, Homo sapiens
cagatactgaaggaagggagtcattttccaggaccgttcatgaccagcataggcccagctgagagccatccccacactcctcagatgcctccatcaacaccaagcagcagtttc

SEQ ID NO: 93 - DNA, 114 bp, Homo sapiens; identical to SEQ ID NO: 92

SEQ ID NO: 94 - DNA, 86 bp, Homo sapiens
ctgaagaagtttccatagaagacagtgcccagagtgacctcaaagaagtgatggtgctgaacgcaacagaatcatttgtatatgag

SEQ ID NO: 95 - DNA, 45 bp, Homo sapiens
tttcatgccacagtggcaactgagaatgaagtcttccgagtgaag

SEQ ID NO: 96 - DNA, 115 bp, Homo sapiens
tcacacttgtggctgatgtgaatgctgaccgaaacatggagatcccaaaaggattgattagaagtgccagcgtaactcctaaaatcaatcagctttgctcacaaactaaaggaag

SEQ ID NO: 97 - DNA, 78 bp, Homo sapiens
gtaagcccacaccattgttttataaaatttctcctgcaacctccaatttttaaagtcttaacttgtcaactggagttt

SEQ ID NO: 98 - DNA, 865 bp, Homo sapiens
cttgtccaggacagtgcagagtttatatcaacacacatatccttaggattttgtttctttgagttcttctccatctgtatcaatgacaacttaatttaattgtgaataaaagagttgctctcccaagcctgaatcctgattgtgacaaccagagtaagaaataaaatagactactctgctttagaatgcagctatgtctaacagttagctagaattctgatcatttggactccaaagtttcttgcctcttctcattcattaattcatcaggagactgtagagcaactaacttctgcattaaataataagagaaatacgaagcaaaaagactaaaaaagtcacgtagcttaactgctcaatttataaatggggcaataaaatgcaaaaaaaagaaaaaaagcttggtgaattcttaggcttacagtgtgcctttcagtctctacacatcatgtaaatattatgcttagctgatttaacttcttgtttgaagtactgtttcatactccattatacatgtcttctagggtggcttacttttaattgtgctgttttctctacactcagtttaaatgactgtacatatatatgtggttgtagagttaatgaataatgagctacaaaccagaacaatgtgactagatagataggatgatctagatttgagatctgggcagattgggaaagagtgactatatggagaagaaagaagtagttacatattgaaataacagtctacttaatgaggacgtgcaacattctttctcaaacttacaaagtgccataaaaagcctctattctctgctcttgggcaggtgtgaaagaaacctaccaaattaatcagatttttctgtatccaggctcctta

SEQ ID NO: 99 - DNA, 113 bp, Homo sapiens
ggtgcatggacgactgaccacaatcaactgtgaggaaggagataaactgaaactcacctgctttgaattggcaccgaaaagtgggaataccggggagttgagatctgtaattc

SEQ ID NO: 100 - DNA, 75 bp, Homo sapiens
gtcatcaagaccaggaaaaacaagaaagacatactcaatcctgattcaagtatggaaacttcaccagactttttc

SEQ ID NO: 101 - DNA, 130 bp, Homo sapiens
tggatgtcattgacgataatgtttatggagataaggtctaagtgcctaaaaaaatgtacatatacctggttgaaatacaacactatacatacacaccaccatatatactagctgttaatcctatggaatg

SEQ ID NO: 102 - DNA, 25 bp, Homo sapiens
tctacaacttctataatttgaaaaa

SEQ ID NO: 103 - DNA, 28 bp, Homo sapiens
ctgcctctgcttctcgctcctcctgccc

SEQ ID NO: 104 - DNA, 107 bp, Homo sapiens
ctcttagtgctcgatgtgacaactccggacggtgcagctgtaaaccaggtgtgacaggagccagatgcgaccgatgtctgccaggcttccacatgctcacggatgcg

SEQ ID NO: 105 - DNA, 84 bp, Homo sapiens
caagtgtgactgtgacccagctggcatcgcagggccctgtgacgcgggccgctgtgtctgcaagccagctgtcactggagaacg

SEQ ID NO: 106 - DNA, 124 bp, Homo sapiens
tcaggttactataatctggatggggggaaccctgagggctgtacccagtgtttctgctatgggcattcagccagctgccgcagctctgcagaatacagtgtccataagatcacctctacctttc

SEQ ID NO: 107 - DNA, 86 bp, Homo sapiens
caacgaaatgggtctcctgcaaagctccaatggtcacagcgccatcaagatgtgtttagctcagcccaacgactagaccctgtcta

SEQ ID NO: 108 - DNA, 142 bp, Homo sapiens
gcctgtcctttgactaccgtgtggacagaggaggcagacacccatctgcccatgatgtgattctggaaggtgctggtctacggatcacagctcccttgatgccacttggcaagacactgccttgtgggctcaccaagactta

SEQ ID NO: 109 - DNA, 76 bp, Homo sapiens
agctgagttactttgagtatcgaaggttactgcggaatctcacagccctccgcatccgagctacatatggagaata

SEQ ID NO: 110 - DNA, 108 bp, Homo sapiens
atgtcctgttgggtacaaggggcaattctgccaggattgtgcttctggctacaagagagattcagcgagactggggccttttggcacctgtattccttgtaactgtca

SEQ ID NO: 111 - DNA, 107 bp, Homo sapiens
agaatcctgacattgagtgtgctgactgcccaattggtttctacaacgatccgcacgacccccgcagctgcaagccatgtccctgtcataacgggttcagctgctca

SEQ ID NO: 112 - DNA, 29 bp, Homo sapiens
gtgtgcaataactgccctcccggggtcac

SEQ ID NO: 113 - DNA, 174 bp, Homo sapiens
ccctttggtgaacatggcccagtgaggccttgtcagccctgtcaatgcaacaacaatgtggaccccagtgcctctgggaattgtgaccggctgacaggcaggtgtttgaagtgtatccacaacacagccggcatctactgcgaccagtgcaaagcaggctacttcggggaccca

SEQ ID NO: 114 - DNA, 115 bp, Homo sapiens
ccatgggctcagagcctgtaggatgtcgaagtgatggcacctgtgtttgcaagccaggatttggtggccccaactgtgagcatggagcattcagctgtccagcttgctataatca

SEQ ID NO: 115 - DNA, 90 bp, Homo sapiens
atggatcagtttatgcagcagcttcagagaatggaggccctgatttcaaaggctcagggtggtgatggagtagtacctgatacagagctg

SEQ ID NO: 116 - DNA, 147 bp, Homo sapiens
gtgctagcagatcccttggtctccagttggccaaggtgaggagccaagagaacagctaccagagccgcctggatgacctcaagatgactgtggaaagagttcgggctctgggaagtcagtaccagaaccgagttcgggatactcaca

SEQ ID NO: 117 - DNA, 30 bp, Homo sapiens
cctcagaccactacgtggggccaaatggct

SEQ ID NO: 118 - DNA, 110 bp, Homo sapiens
ccacgttgagtcagccagtaacatggagcaactgacaagggaaactgaggactattccaaacaagccctctcactggtgcgcaaggccctgcatgaaggagtcggaagcg

SEQ ID NO: 119 - DNA, 103 bp, Homo sapiens
ccctggcccagcagttgacaagggaggccactcaagcggaaattgaagcagataggtcttatcagcacagtctccgcctcctggattcagtgtctcggcttca

SEQ ID NO: 120 - DNA, 60 bp, Homo sapiens
agaggatcaaacaaaaagcggattcactctcaagcctggtaaccaggcatatggatgagt

SEQ ID NO: 121 - DNA, 96 bp, Homo sapiens
ctgctttcccgtgccaatcttgctaaaagcagagcacaagaagcactgagtatgggcaatgccactttttatgaagttgagagcatccttaaaaac

SEQ ID NO: 122 - DNA, 31 bp, Homo sapiens
ggccctggaaatctccagtgagattgaacag

SEQ ID NO: 123 - DNA, 393 bp, Homo sapiens
atcgacatgtgtgttggtgccagtagcaccaaacacaagggtggtgtggagggaaaaagaacattgagcttattttaacctctgaggctcagagccctgttgtggcccatgggagccccagattaaaagactatggtagcaaagacgcatgacagagaatgatgtgtttttttgtcctccgggttttcccaaatggttcctaactctgttcaacatttggtgagcattgaactgagagagaagcactgtctggccgctgaccttcctagtcatacccccagattagcttgtttgaggcagagcttggcaaagtacccctgtccctaagtctgattctctcattattcatctaatttactccatcagggcccggctgccgctgtattttttcta

SEQ ID NO: 124 - DNA, 79 bp, Homo sapiens
cccagaaggttgataccagagccaagaacgctggggttacaatccaagacacactcaacacattagacggcctcctgca

SEQ ID NO: 125 - DNA, 407 bp, Homo sapiens
ccctgttttaccgttgctaagatgggtcactgaacacctattgcacttgggggtaaaggtctgtgggccaaagaacaggtgtatataagcaacttcacagaacacgagacagcttgggaatcctgctaaagagtctggcctggaccctgagaagccagtggacagttttaagcagaggaataacatcaccactgtatatttcagaaagatcactagggcagccgagtggaggaaagcttgaagagggggttagagagaaggcaggttgagactacttaagatattgttgaaataattgaagagagaaatgacaggagcctgctctaaggcagtagaatggtggctgggaagatgtgaaggaagattttcccagtctgtgaagtcaagaatcacttgccggccgggtg

SEQ ID NO: 126 - DNA, 203 bp, Homo sapiens
ggagcagaagctttcccgagccaagacccagatcaacagccaactgcggcccatgatgtcagagctggaagagagggcacgtcagcagaggggccacctccatttgctggagacaagcatagatgggattctggctgatgtgaagaacttggagaacattagggacaacctgcccccaggctgctacaatacccaggctcttg

SEQ ID NO: 127 - DNA, 52 bp, Homo sapiens
tctcaactgaggttcttgggatacagatctcagggctcgggagccatgtcat

SEQ ID NO: 128 - DNA, 36 bp, Homo sapiens
gtttaatgggtatgctcaggtcaactgacctgaccc

SEQ ID NO: 129 - DNA, 112 bp, Homo sapiens
gtggttgtcttattgcaccatactccttgcttcctgatgctgggcaatgaggcagatagcactgggtgtgagaatgatcaaggatctggaccccaaagaatagactggatgg

SEQ ID NO: 130 - DNA, 69 bp, Homo sapiens
taagtggagtcctggaatttggacaagtgctgttgggatatagtcaacttattctttgagtaatgtgac

SEQ ID NO: 131 - DNA, 178 bp, Homo sapiens
ttcttgctgatcagagttcctcctacttacaacccagggtgtgaacatgttctccattttcaagctggaagaagtgagcagtgttggagtgaggacctgtaaggcaggcccattcagagctatggtgcttgctggtgcctgccaccttcaagttctggacctgggcatgacatccttt

SEQ ID NO: 132 - DNA, 332 bp, Homo sapiens
aaagtgtggcttgggcattgaaagaggtaaaattctctagatttattagtcctaattcaatcctacttttcgaacaccaaaaatgatgcgcatcaatgtattttatcttattttctcaatctcctctctctttcctccacccataataagagaatgttcctactcacacttcagctgggtcacatccatccctccattcatccttccatccatctttccatccattacctccatccatccttccaacatatatttattgagtacctactgtgtgccaggggctggtgggacagtggtgacatagtctctgccctcatagagttgattgtcta

SEQ ID NO: 133 - DNA, 216 bp, Homo sapiens
gaacatatgttgcaagaccctcccatgggggcacttgagttttggcaaggctgacagagctctgggttgtgcacatttctttgcattccagctgtcactctgtgcctttctacaactgattgcaacagactgttgagttatgataacaccagtgggaattgctggaggaaccagaggcacttccaccttggctgggaagactatggtgctgccttg

SEQ ID NO: 134 - DNA, 27 bp, Homo sapiens
atttgccttatgttatgggctatttgt

SEQ ID NO: 135 - DNA, 141 bp, Homo sapiens
attctgacaggttcctggtctgaccaaacatatccagaaggcacccaggctatctataaatgccgccctggatatagatctcttggaaatgtaataatggtatgcaggaagggagaatgggttgctcttaatccattaagg

SEQ ID NO: 136 - DNA, 46 bp, Homo sapiens
ttaatattgtagcaattatgcctgaattatatcactattgccagtc

SEQ ID NO: 137 - DNA, 85 bp, Homo sapiens
tggacatcctggagatactccttttggtacttttacccttacaggaggaaatgtgtttgaatatggtgtaaaagctgtgtataca

SEQ ID NO: 138 - DNA, 54 bp, Homo sapiens
caattgctaggtgagattaattaccgtgaatgtgacacagatggatggaccaat

SEQ ID NO: 139 - DNA, 124 bp, Homo sapiens
gtcagtagtgcaatggaaccagatcgggaataccattttggacaagcagtacggtttgtatgtaactcaggctacaagattgaaggagatgaagaaatgcattgttcagacgatggtttttgga

SEQ ID NO: 140 - DNA, 438 bp, Homo sapiens
ctgaggaaatcttggctaaatagtgatgacacaaaaacaggtcagttacttttcagagatgtaatgacaatgagttaaatcaatgtctttgacaaaaagtcctgttgataattcctgtcttatcaataactagaagatgtgttattttttgcaggtcattcagtgaaaacatcacaataaaactatatttatgatcaattttatttatacagttgatgaatgttactggtcactatttatttcaagaaggctaatttatcctgaaactaaataaaatcagaagcataattttaatcagaattttaactttcttcagataaatcatttattaagcggtcaagtcaaaacagaacttttgtttggttgactgatttacctgatggaaacaacatttctgttttcatataattatgtcctggtcacagtcctttaatttgc

SEQ ID NO: 141 - DNA, 141 bp, Homo sapiens
aatggatctcctatatctcagaagattatttataaggagaatgaacgatttcaatataaatgtaacatgggttatgaatacagtgaaagaggagatgctgtatgcactgaatctggatggcgtccgttgccttcatgtgaa

SEQ ID NO: 142 - DNA, 140 bp, Homo sapiens
aaatggtgactactcacctttaaggattaaacacagaactggagatgaaatcacgtaccagtgtagaaatggtttttatcctgcaacccggggaaatacagcaaaatgcacaagtactggctggatacctgctccgagat

SEQ ID NO: 143 - DNA, 153 bp, Homo sapiens
ggtctatatcatgagaatatgcgtagaccatactttccagtagctgtaggaaaatattactcctattactgtgatgaacattttgagactccgtcaggaagttactgggatcacattcattgcacacaagatggatggtcgccagcagtacca

SEQ ID NO: 144 - DNA, 70 bp, Homo sapiens
tttgtacagggtaaatctatagacgttgcctgccatcctggctacgctcttccaaaagcgcagaccacag

SEQ ID NO: 145 - DNA, 25 bp, Homo sapiens
atggctggtctcctactcccagatg

SEQ ID NO: 146 - DNA, 180 bp, Homo sapiens
cttctgatcgaaggtcatccctctccagcttgagtggatcaaagatgacaagggccaatggaaccaagtttgagtcttgccaggtcaatacttgggtcctgagtatggtgactagtatctgttttgttatgtgtgtattattccagccagaatgggaaatgctaattcagctcctccagg

SEQ ID NO: 147 - DNA, 26 bp, Homo sapiens
aacagcagatggtgaaacatcaggat

SEQ ID NO: 148 - DNA, 133 bp, Homo sapiens
cctgatcgcaagaaagaccagtataaagttggagaggtgttgaaattctcctgcaaaccaggatttacaatagttggacctaattccgttcagtgctaccactttggattgtctcctgacctcccaatatgta

SEQ ID NO: 149 - DNA, 112 bp, Homo sapiens
agcaagtacaatcatgtggtccacctcctgaactcctcaatgggaatgttaaggaaaaaacgaaagaagaatatggacacagtgaagtggtggaatattattgcaatcctag

SEQ ID NO: 150 - DNA, 25 bp, Homo sapiens
taatgaagggacctaataaaattca

SEQ ID NO: 151 - DNA, 158 bp, Homo sapiens
cctgtggagatatacctgaacttgaacatggctgggcccagctttcttcccctccttattactatggagattcagtggaattcaattgctcagaatcatttacaatgattggacacagatcaattacgtgtattcatggagtatggacccaacttccc

SEQ ID NO: 152 - DNA, 130 bp, Homo sapiens
cttaagaagtgcaaatcatcaaatttaattatacttgaggaacatttaaaaaacaagaaggaattcgatcataattctaacataaggtacagatgtagaggaaaagaaggatggatacacacagtctgca

SEQ ID NO: 153 - DNA, 32 bp, Homo sapiens
tggcacaaatacaattatgcccacctccacct

SEQ ID NO: 154 - DNA, 25 bp, Homo sapiens
gaagatggcagtcaataccactctg

SEQ ID NO: 155 - DNA, 97 bp, Homo sapiens
cctcagatagaacacggaaccattaattcatccaggtcttcacaagaaagttatgcacatgggactaaattgagttatacttgtgagggtggtttca

SEQ ID NO: 156 - DNA, 123 bp, Homo sapiens
gatttctcatggtgttgtagctcacatgtcagacagttatcagtatggagaagaagttacgtacaaatgttttgaaggttttggaattgatgggcctgcaattgcaaaatgcttaggagaaaa

SEQ ID NO: 157 - DNA, 116 bp, Homo sapiens
tattcttcattcaaagtgtaagtggtaccaataagaaagtaaacagggactctagaaattcataaggttttcttgaatattctggactgctgtgggaaattatagctgtagtaatt

SEQ ID NO: 158 - DNA, 666 bp, Homo sapiens
tgtgaactttaagcatcctctgatgtatattctcagacttctcatctctgttcttagggcacagctgcctctactcatcaatctccacattattcaatcttctgtcagtttatcaacaatctgcctataagtacattttctgaaatattttaaaaaatcattataagtatttcacatttgatagaagcaaaaaatttggaaatgcacacacaatataggtggtgtattattccgttttcacactgctgtaaagaccttcctgagactgggtaatttataaaagaaaaaattttaattgatcacagttcctcatgactgaggaggtgtcatgaaacttaccattaccgctgaaggggaagcaggcaccttcttcacaaggtggcaggagagagaggagtgagtgaaggaggaacttctaaacagttattaaatcatcatatcttgtgagaactcactcaccatcgtgagaacagcatgtgggaaactgccaccatgatccaatcacttcccaccaggtctctctctcaacacctggagattattattcaagatgagatttgggtgaggacacaaagcctaaccatatcaggtggcaagtatggacaaaaataatgtgaacaaaaaaatgtgtaatctcaattgctacggctaccaatatttcttcag

SEQ ID NO: 159 - DNA, 29 bp, Homo sapiens
cagattgtctcagtttacctagctttgaa

SEQ ID NO: 160 - DNA, 83 bp, Homo sapiens
agcaagtgacttacacttgtgcaacatattacaaaatggatggagccagtaatgtaacatgcattaatagcagatggacagga

SEQ ID NO: 161 - DNA, 27 bp, Homo sapiens
acacctcctgtgtgaatccgcccacag

SEQ ID NO: 162 - DNA, 32 bp, Homo sapiens
acgttatcaatgtaggagcccttatgaaatgt

SEQ ID NO: 163 - DNA, 83 bp, Homo sapiens
tcccgttgtcagtatatgctccagcttcatcagttgagtaccaatgccagaacttgtatcaacttgagggtaacaagcgaata

SEQ ID NO: 164 - DNA, 63 bp, Homo sapiens
tccgtgtgtaatatcccgagaaattatggaaaattataacatagcattaaggtggacagccaa

SEQ ID NO: 165 - DNA, 25 bp, Homo sapiens
ttgaatttgtgtgtaaacggggata

SEQ ID NO: 166 - DNA, 26 bp, Homo sapiens
aactggagtatccaacttgtgcaaaa

SEQ ID NO: 167 - DNA, 83 bp, Homo sapiens; identical to SEQ ID NO: 163

SEQ ID NO: 168 - DNA, 26 bp, Homo sapiens
aactggagtatccaacttgtgcaaaa

SEQ ID NO: 169 - DNA, 26 bp, Homo sapiens
ttattcagaactttagtattaaatca

SEQ ID NO: 170 - DNA, 88 bp, Homo sapiens
tattcatacgtaaaattttggattaatttgtgaaaatgtaattataagctgagaccggtggctctcttcttaaaagcaccatattaaa

SEQ ID NO: 171 - DNA, 26 bp, Homo sapiens
accatactttccagtagctgtaggaa

SEQ ID NO: 172 - DNA, 1501 bp, Homo sapiens
gaagccggttctcccacattcctgggtgagggactgggtggagggtgtgcctgcctcaggctccttgggggaggccccctgaagggctggggaaaatcctactgagccccaggctctcctgcctgcactggcccagtgcgggggcgggggggcggggggatcctggacattaactctctcctaggcacctgggagcttcagagaggaagaaggtaaggtaagaagcagattctctgcgcaggactttcttagtcctcaggctatagagttaaagaaagaagtatctgtagaaggtggagtcaccttttgtttgagtaaccgtttcacccaccctggctgagggtggccaggaactccccaagttgtgcattaatggaggggggtcacacagatcctacatttttttgtttttgtttttttttttttgagacgcagtgattacaggtgtgagccaccggatcctacatttcaaatgcataaaaatctagatatgggctgggcgcagtagctcatgcctgtaatcccagcactttgggaggctgaggcaggcagatcatgaggtcaggagatcgagtccatcctggctaacatggtgaaaccccgtctctactaaaaatacagaaagccgggcatggcagcgggcgcctgtaatcccagctactcggaaagctgaggcaggagaatcgcttgaacccaggagtcagaggttgcagtgagcagagatcacgccactgcactccaacctgggcgacagagcgagactccacctcaaaacaaaataaacaaaatactagatctggaagagatcttagggattattaaattcagacaacctcattttttatagatggggaaacaagcacagactccaagggtctcatccaagatcacacagttgcagatgctggctacaagtctcctgcctcaaccacctgtattaccccattcagggtctcaagaagggtctataagacactatccattgtgtttcgggctgagtccatagagacaaccacagacatgggggactctgcccacagggaaggcaagggctctggccatggagctggatgggaagactctgaagcccgaagacattgaatcctgtgcagggaaagagcgagggttttgtgtacaacacacctgcatacctggatgtgaatctcagctccaccccttcaccaactctgtgtggcctgggcaagccattctaagggaaccctccacactgcaactttcatgtctataaaatgggaataaccatgcattccttacaggacttttttggtgtgaggattaaatgagagaatatgttgaaaagtgcttggtaaatatattaatactatgcattccctcttctttgaatgacgtgacccaggtagtcaggcttctgaccactagagggcagcagaaggtactggaaaactgggccgagtgaaccagagattagatggggtccagagagcagggatgaacttacccgtgtggattctggcaactc

SEQ ID NO: 173 - DNA, 29 bp, Homo sapiens
gcctctttgttgctgaatctctggaattt

SEQ ID NO: 174 - DNA, 276 bp, Homo sapiens
tgacaatcattaaaccagccgggcctgatttcccagcactgcctgctaagatccgggccaagtggcactgaatatgcaaatcacctggggccaggagcccagtctaaaggccaggaaatcccctccatccaatgagacaccagctcaggttactgcaggggacacactataaagccctgagctcagggaggagctccctccaggctctatttagagccgggtaggggagcgcagcggccagatacctcagcgctacctggcggaactggatttctc

SEQ ID NO: 175 - DNA, 62 bp, Homo sapiens
gggtccagaggatttgcagttctgaacctgcacactccagtctaggatctccgagcaagagc

SEQ ID NO: 176 - DNA, 182 bp, Homo sapiens
gaatggccatgacgccgctagtctggctccagggccccagagatctgaggagggaagcccagctggaggctcctgtggtcctgccctggtctgagatcttggagcccttcttgaagagacggtgtccgcagagttgctgatcttcctgcccctgggggctactcttgcccagggttgggcaa

SEQ ID NO: 177 - DNA, 130 bp, Homo sapiens
gctgcaacctgtgagattagcaacatttttagcaactacttcagtgcgatgtacagctcggaggactccaccctggcctctgttccccctgctgccacctttggggccgatgacttggtactgaccctga

SEQ ID NO: 178 - DNA, 169 bp, Homo sapiens
tctaagggcctgttagacaaatgggggaataggcagggaggagggtctctaggcaaattccagggctagaggctgagacttagtgactgaggtgctgggggttgtggggctgtgacaggcagagggaggtgtcagataccaggacaagggtgttgtgaatgctacctcc

SEQ ID NO: 179 - DNA, 132 bp, Homo sapiens
cagttctggtcgaagacgcaggttctggactggatcagctaccaagtggagaagaacaagtacgacgcaagcgccattgacttctcacgatgtgacatggatggcgccaccctctgcaattgtgcccttgag

SEQ ID NO: 180 - DNA, 42 bp, Homo sapiens
ccacatgttgagctgagtcgagttcagtgtggccgtaggcag

SEQ ID NO: 181 - DNA, 45 bp, Homo sapiens
ttccagctcttctgatgagctcagttggatcattgagctgctgga

SEQ ID NO: 182 - DNA, 60 bp, Homo sapiens
ccctccacagagtgctagagatgaccccctccccagacttcttcctccctcaattagaaa

SEQ ID NO: 183 - DNA, 30 bp, Homo sapiens
gggcagcccctttgcccaggagctgctgga

SEQ ID NO: 184 - DNA, 26 bp, Homo sapiens
gcagctgtggcgcaggagccccctcc

SEQ ID NO: 185 - DNA, 61 bp, Homo sapiens
tgagagccagcagcgtggttgagcagagggtgggccggcaggggacttactctgaccccgc

SEQ ID NO: 186 - DNA, 76 bp, Homo sapiens
tggtgcttctcggagctcccactcctcagactccggtggaagtgacgtggacctggatcccactgatggcaagctc

SEQ ID NO: 187 - DNA, 111 bp, Homo sapiens
atggttttcgtgactgcaagaagggggatcccaagcacgggaagcggaaacgaggccggccccgaaagctgagcaaagagtactgggactgtctcgagggcaagaagagca

SEQ ID NO: 188 - DNA, 35 bp, Homo sapiens
agaggggacacctggatggcaaactgatggaggct

SEQ ID NO: 189 - DNA, 92 bp, Homo sapiens
cccacctgtgggagttcatccgggacatcctcatccacccggagctcaacgagggcctcatgaagtgggagaatcggcatgaaggcgtcttc

SEQ ID NO: 190 - DNA, 115 bp, Homo sapiens
gtactactacaaacgggagatcctggaacgggtggatggccggcgactcgtctacaagtttggcaaaaactcaagcggctggaaggaggaagaggttctccagagtcggaactga

SEQ ID NO: 191 - DNA, 399 bp, Homo sapiens
tcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctc

SEQ ID NO: 192 - DNA, 40 bp, Homo sapiens
gaaatttgggcctttggatcgaatatggtcaagaggttgg

SEQ ID NO: 193 - DNA, 657 bp, Homo sapiens
tgctgtcatgacaccgctcgagtgaccttgaccttgaccaagtctgtcctgtttaggactgatttttcctattaggctagggtttggacctgatgttctcaagatgtctagaattgcatggctggccttgtggaatagatggttttgcattccagccaagtgtgctgtaaactgtatatctgtaatatgaatcccagcttttgagtctgacaaaatcagagttaggatcttgtaaaggaaaaaaaaaaaaaaacaaaacaaaatggagatgagtacttgctgagaaagaatgagggaaggagttggcatttgttgaaagtgtagtctttttctcttttttttttaattgcaacttttactttagatttaggaggtcgtgcgcaggtttgttacatgggtatattgtgtgatgctgagcttgggatgcgaatgatcctgtcacccaggtagtgagtatagcacccagtgaaactgtagtctcatgccaggcactgtgctagcccactctggctcatttaatcctctcctaagaagagaggagacacagcgtccccatttgacagatgcagaaagaggttccacaggtgtgccttgattctgtcctaaaaccgtttcccggaagcttttcctggtgtgggcgcttctaacctaatcctc

SEQ ID NO: 194 - DNA, 37 bp, Homo sapiens
tggaaataccaatcagattgttggctgaagtgatgtg

SEQ ID NO: 195 - DNA, 64 bp, Homo sapiens
cagggtaacgctgtcttgtggacccgcacttcccacccgagacctctcactgagcccgagccgc

SEQ ID NO: 196 - DNA, 114 bp, Homo sapiens
gggaaccgacatgctcccggagatcgccgccgccgtgggcttcctctccagcctcctgaggacccggggctgcgtgagcgagcagaggcttaaggtcttcagcggggcgctcca

SEQ ID NO: 197 - DNA, 161 bp, Homo sapiens
ccctatgaggtgtcctaccgcattggggaggacggctccatctgcgtcttgtacgaggaggccccactggccgcctcctgtgggctcctcacctgcaagaaccaagtgctgctgggccggagcagcccctccaagaactacgtgatggcagtctccagcta

SEQ ID NO: 198 - DNA, 216 bp, Homo sapiens
cgtgctcatgctgccgtgacaacaggccaccacatacctcaacctggggaactgtatttttaaatgaagagctatttatatatattatttttttttaagaaaggaggaaaagaaaccaaaagttttttttaagaaaaaaaatccttcaagggagctgcttggaagtggcctccccaggtgcctttggagagaactgttgcgtgcttgagtctgtga

SEQ ID NO: 199 - DNA, 642 bp, Homo sapiens
aggggcctgtagatgttgctttccagccaggaatctaaagctttgggttttctgaggggggggaggagggaactggaggttattggggttaggatggaagggaactctgcacaaaacctttgctttgctagtgctgctttgtgtgtatgtgtggcaaataatttgggggtgatttgcaatgaaattttgggacccaaagagtatccactggggatgttttttggccaaaactcttccttttggaaccacatgaaagtcttgatgctgctgccatgatccctttgagaggtggctcaaaagctacagggaactccaggtcctttattactgccttcttttcaaaagcacaactctcctctaaccctcccctcccccttcccttctggtcgggtcatagagctaccgtattttctaggacaagagttctcagtcactgtgcaatatgccccctgggtcccaggagggtctggaggaaaactggctatcagaacctcctgatgccctggtgggcttagggaaccatctctcctgctctccttgggatgatggctggctagtcagccttgcatgtattccttggctgaatgggagagtgccccatgttctgcaagactacttggtattcttgtagggccgacacta

SEQ ID NO: 200 - DNA, 134 bp, Homo sapiens
ccctgcctttttagaagcagcctcatggtctcatgcttaatcttgtctctcttctcttctttatgatgttcactttaaaaacaacaaaacccctgagctggactgttgagcaggcctgtctctcctattaagta

SEQ ID NO: 201 - DNA, 74 bp, Homo sapiens
ggttactaattgtatgatagtgtttttatatggaagaatgtacagcttatggacaaatgtacacctttttgtta

SEQ ID NO: 202 - DNA, 25 bp, Homo sapiens
gtcattcccgcctccgagagcccag

SEQ ID NO: 203 - DNA, 217 bp, Homo sapiens
tgctggccctcttcggcgtggtgctcggcctgatggagactgtgtgcagccccttcacggccgccagacgtctgcgggaccaggaggcagccgtggcggagctgcaggccgccctggagcgacaggctctccagaagcaagccctgcaggagaaaggcaagcagcaggacacggtcctcggcggccgggccctgtccaaccggcagcacgcctccta

SEQ ID NO: 204 - DNA, 121 bp, Homo sapiens
caggagcctgactccgctgggagagtgcaggagcacgtgctgttttttatttggacttaacttcagagaaaccgctgacatctagaactgacctaccacaagcatccaccaaaggagtttg

SEQ ID NO: 205 - DNA, 132 bp, Homo sapiens
gctgtgcagcactgcattgtcatgacatttccaacactgtgtgaattatctaaatgcgtctaccattttgcactagggaggaaggataaatgctttttatgttattattattaattattacaatgaccacca

SEQ ID NO: 206 - DNA, 38 bp, Homo sapiens
ggcagcaaggctaagtttgccggcaggaacttcagaaa

SEQ ID NO: 207 - DNA, 272 bp, Homo sapiens
ctgcagaacaaaccgccgcacggaattaggggccgccgtccgcgcctgccaggcttggaagcggactcgcccccagggccaccgccctaggaaacctcccgtcggaagcctcccaagcaagccgctcacccgcggctcccgcgcgaggcggcgtgggcgtgggcgcggccctggcgcggcggcgcgcgcggggtgaagggagcccggcgcgctggctgcggcgacggcggccgttgctgcgccgggtactggggtcgctgcctgaggcgcag

SEQ ID NO: 208 - DNA, 28 bp, Homo sapiens
ccggggcctgggctcgctgtggactcgt

SEQ ID NO: 209 - DNA, 120 bp, Homo sapiens
ggcgaccgagcagaggcctttccacctggtggtgttcggcgcgtctggcttcaccggccagttcgtgaccgaggaggtggcccgggagcaggtggacccggagcggagctcccgcctgcc

SEQ ID NO: 210 - DNA, 77 bp, Homo sapiens
caaaggggtttatatcattggaagcagcggctttgactccattccagcagatctgggagtaatatataccagaaata

SEQ ID NO: 211 - DNA, 113 bp, Homo sapiens
gggttgagcattcatgatggtacctggaagtcagcaatttatggttttggagatcagagtaatttgagaaaactaagaaatgtatcaaatctgaaacctgtcccgctcattgg

SEQ ID NO: 212 - DNA, 114 bp, Homo sapiens
gccaatttcttattgtcgggaactcaaaggttattccattccttttatgggatctgatgtgtctgttgtaaggaggactcaacgttacttgtatgaaaatttagaggaatcacc

SEQ ID NO: 213 - DNA, 75 bp, Homo sapiens
gttcagtatgctgcgtatgtaactgtgggaggcatcacctctgttattaagctgatgtttgcaggacttttcttt

SEQ ID NO: 214 - DNA, 36 bp, Homo sapiens
cccatggttcttctcctttggctatttttcaaaaca

SEQ ID NO: 215 - DNA, 30 bp, Homo sapiens
gatgctgcctcattcacgctgacattcttt

SEQ ID NO: 216 - DNA, 33 bp, Homo sapiens
tacagataagaacaaaccaaatatcaaaatttg

SEQ ID NO: 217 - DNA, 48 bp, Homo sapiens
gtggctacccccatagctatggttcaggcagccatgactcttctaagt

SEQ ID NO: 218 - DNA, 65 bp, Homo sapiens
aaaacaaagttgattgacagactcaacaaacacggtattgagtttagtgttattagcagctctga

SEQ ID NO: 219 - DNA, 105 bp, Homo sapiens
ctgaagtcataacgtgcgtgaattaacagcttctctatttgatatttgaaattcttctgtaagcctgtctgagtgtatgtggaaacgattgtcaaatctaaaata

SEQ ID NO: 220 - DNA, 138 bp, Homo sapiens
tttcacgaatgagctggcaggtctaatgggggaggcggcgtcccagtctgtgttgcagcagcattctcatcgggggtgcgcacaccatcgttactgtcgggcagtaactgccgcttgccttgccgcagtaggagggaa

SEQ ID NO: 221 - DNA, 26 bp, Homo sapiens
atctacactgattttggactgttacc

SEQ ID NO: 222 - DNA, 36 bp, Homo sapiens
ggtttaatgtttggacctgccgatgtatttgtatag

SEQ ID NO: 223 - DNA, 125 bp, Homo sapiens
gtagaaacatgctgcttaagtggcctaacctgtttcttgccaataagtaggcttatcattttatctttacgtaattctatatctgtgactaggtttttaaggatacagcttataagttgctatca

SEQ ID NO: 224 - DNA, 25 bp, Homo sapiens
cagtcgtgtaattggcccaagtcat

SEQ ID NO: 225 - DNA, 116 bp, Homo sapiens
ccttcggtcacctgttggctacacagacccctcccctcgtgtcagctcaggcagctcgaggcccccgaccaacacttgcaggggtccctgctagttagcgccccaccgccgtggag

SEQ ID NO: 226 - DNA, 38 bp, Homo sapiens; identical to SEQ ID NO: 206

SEQ ID NO: 227 - DNA, 40 bp, Homo sapiens
actggtgccccttgccgatctgagcgcttggccaagtaca

SEQ ID NO: 228 - DNA, 70 bp, Homo sapiens
aatggttggggcgtcatggtgtctcatcgttcgggggagactgaagataccttcatcgctgacctggttg

SEQ ID NO: 229 - DNA, 91 bp, Homo sapiens
ccaacccaaagaggatcgccaaggccgtgaacgagaagtcctgcaactgcctcctgctcaaagtcaaccagattggctccgtgaccgagtc

SEQ ID NO: 230 - DNA, 123 bp, Homo sapiens
cactgataaggtggtcatcggcatggacgtagcggcctccgagttcttcaggtctgggaagtatgacctggacttcaagtctcccgatgaccccagcaggtacatctcgcctgaccagctggc

SEQ ID NO: 231 - DNA, 26 bp, Homo sapiens
tcctcccagtcggtgcagcaaacttc

SEQ ID NO: 232 - DNA, 30 bp, Homo sapiens
tgccatgcttctctgctctgctctccccag

SEQ ID NO: 233 - DNA, 124 bp, Homo sapiens
taagtttggtgcgaacgccattctgggggtgtcccttgccgtctgcaaagctggtgccgttgagaagggggtccccctgtaccgccacatcgctgacttggctggcaactctgaagtcatcctg

SEQ ID NO: 234 - DNA, 215 bp, Homo sapiens
caggggctttcctgtttatggaagagcttattctgagagctgtagaagcctattggattccctgtcacgcacgagaacaatccatgcatgacataattctaacctgcccgctgcctcaccccacttttgggagcagatggaattgcatcagaagaatgagacacttcgagccctgaggtttcttcccccctgcaactctctggacctttgaagaa

SEQ ID NO: 235 - DNA, 32 bp, Homo sapiens
caataaaactattgcgcctgccctggttagca

SEQ ID NO: 236 - DNA, 265 bp, Homo sapiens
cctttagtctgcagttggcgtttccagtgcatggtcttgcaaactaacctccagtcagatcgttctgagccagctgctgttttgtgtggctctaaccctctggggtcctaggtaggagcactcagactgggccggaaagtcctccgattctggggggaaaggggagagggggaagaggtcccacagaaggtcccttggtgggcttccgcgtcggcctcaacagtggttctctctaacaatgctgctcaagcctgttttaaagtta

SEQ ID NO: 237 - DNA, 26 bp, Homo sapiens
gcgtctccagacccattaagtatatt

SEQ ID NO: 238 - DNA, 32 bp, Homo sapiens
gcccagtggtgcttcaactggtatctatgagg

SEQ ID NO: 239 - DNA, 72 bp, Homo sapiens
atgtctattctcaagatccatgccagggagatctttgactctcgcgggaatcccactgttgaggttgatctc

SEQ ID NO: 240 - DNA, 574 bp, Homo sapiens
tcaacgactcgacgccaacggggtctctcggatcgcggcgcgaggcaggaggggcggggcaggagggccgcggcaggcccgggccgccaaagttgtcagcaaggtcgagggccggacgtggggccccagagcgacgctgagtgcgtgcgggactcggagtacgtgacggagccccgagctctcatgcccgccacgccgccccgggccatcccccggagccccggctccgcacaccccagttcggctcaccggtcctatctggggccagagtttcgcccgcaccactacagggccgctggggagtcggggccccccagatctgcccgcctcaagtccgcgggacgtcacccccctttccacgctactgcagccgtcgcagtcccacccctttccgggaggtgagggaatgagtgacggctctcccgacgaatggcgaggcggagctgagggggcgtgccccggaggcgggaagtgggtggggctcgccttagctaggcaggaagtcggcgcgggcggcgcggacagtatctgtgggtacccggagcacggagatctcgccggctttacgttcacc

SEQ ID NO: 241 - DNA, 227 bp, Homo sapiens
ccctgctcacattactggaggttttccggaggaagctggggcccctgggagtggacacagggtgcagggagcagttcttgttttatctttgctgggggatggggttggggccttatataccatatctatatatacaaaatttgtttggcaagggagtgggcggcagttttattactaaagttttataagtagttaaaataatgtgtttaaaatatgataatcccact

SEQ ID NO: 242 - DNA, 218 bp, Homo sapiens
cagaatgaactgtcaagggaggtgctggagagggattaacctgtgctgcctgggaccctcagggtcttaggttggggagtgtgaataggagtttgcagatggagaataggaagggcattccaggcagagggaaacctgtgcagagaccaagaggtgtggaaggaaaagtggggttggggctgggtggtctggattatggcctggatgcaataaagtac

SEQ ID NO: 243 - DNA, 30 bp, Homo sapiens
cttgttggctaggctggagtaaaatggtgc

SEQ ID NO: 244 - DNA, 558 bp, Homo sapiens
tctgtgcacgactcaactgccaagggcatcactggccaattcttggatttagggattggctaggagttgctggggtccactcctgggcctgccccagctccttgcccagggagagggaaagagttaacggtgtgggccactccagcttgcccttccactgccactcactggggtgaggctgggggtcagcttggtgaggattggggcttctagattgtctaggcaggaggtgaaacttaggccagagtcagatttgagctgagccaggggaggccttggcaacctacttctactcagatttcattgctggatgcggaaggggtaggcccaaaatatatacaggatcttactgtcccttgaagcccagccacaagtgttggagctgcagagagaccccaaaggtagtagattgtgccagatacaaatgggtcccatccagtgcttcatactccttcagtcactatcccagacagtgagccccagatctcctagctctggcttctgtgtcccacacggcctgttcccagcttctctcctggttcccttgttacggattca

SEQ ID NO: 245 - DNA, 540 bp, Homo sapiens
cgctcttctggaagccgtacatctatgcgggctaccggccgctgcatcagacctggcgcttctatttccgcacgctgttccagcagcacaacgaggccgtgaatgtctggacccacctgctggcggccctggtactgctgctgcggctggccctctttgtggagaccgtggacttctggggagacccacacgccctgcccctcttcatcattgtccttgcctctttcacctacctctccttcagtgccttggctcacctcctgcaggccaagtctgagttctggcattacagcttcttcttcctggactatgtgggggtggccgtgtaccagtttggcagtgccttggcacacttctactatgctatcgagcccgcctggcatgcccaggtgcaggctgtttttctgcccatggctgcctttctcgcctggctttcctgcattggctcctgctataacaagtacatccagaaaccaggcctgctgggccgcacatgccaggaggtgccctccgtcctggcctacgcactggacattagtc

SEQ ID NO: 246 - DNA, 499 bp, Homo sapiens
cagttactctgaatggtctttgctaagaacaatttaatgattaagtaaggtcagtgtccttggaagtccaaactctagccagatttccctggtctacacccctagggataaggtaaatgtttaagcacacagtgaacttcctgaggcccccaaatctaatggaactagctattgagggctaaaagaggatggtttttttagaaaactcgaagcaaatctctcaggctggggatatttcaaagactactactattattattaataacaattgcaatatttgttgagtccctaaatgaagctaaaactttgttctaataaatttaatctttacagcaacctatgaggtagataatattgtcattcccatgagggagctaaggatcagagaaggtaagtcacttgtctaaggtcacatagctagcatgttatgcaatcaggagtcaaacctggtttgtctgaatctgaagtccatctgctctgtgcacttttataccgtctg

SEQ ID NO: 247 - DNA, 139 bp, Homo sapiens
gctattcacagatgcgaacatagtacactgcagcctccaactcctagcctcaagtgatcctcctgtctcaacctcccaagtaggattacaagcatgcgccgacgatgcccagaatccagaactttgtctatcactctcc

SEQ ID NO: 248 - DNA, 27 bp, Homo sapiens
cttcttggcctaactcttccagttagg

SEQ ID NO: 249 - DNA, 77 bp, Homo sapiens
ggcagcagcgtcgtcataggtaatattggtgccctgatgggctacgccacccacaagtatctcgatagtgaggagga

SEQ ID NO: 250 - DNA, 109 bp, Homo sapiens
tcgcagtcgccgggctgcccgcgctgggcttcaccggcgccggcatcgcggccaactcggtggctgcctcgctgatgagctggtctgcgatcctgaatgggggcggcgt

SEQ ID NO: 251 - DNA, 51 bp, Homo sapiens
taagaaaaagtgctcggagagctcggacagcggctccgggttctggaaggc

SEQ ID NO: 252 - DNA, 40 bp, Homo sapiens
gtatcgcttttcttgtgctacctgctgctcttcacttgca

SEQ ID NO: 253 - DNA, 30 bp, Homo sapiens
gcgacagggaggaagtttcaataaagcagc

SEQ ID NO: 254 - DNA, 910 bp, Homo sapiens
tcacaactgggtcaacgctttaggctgagtcactcctcgggtctctccataattcagcccaacaatgcttggtttatttcaatcagctctgacacttgtttagacgattggccattctaaagttggtgagtttgtcaagcaactatcgacttgatcagttcagccaagcaactgacaaatcaaaaacccacttgtcagttcagtaaaataatttggtcaaacaacagtctattgcattgatttataaatagttgtcagttcacatagcaatttaatcaagtaatcattaattagttaccccctatatataaatatatgtaatcaatttcttcaaatagcttgcttacatgataatcaattagccaaccatgagtcatttagaatagtgataaatagaatacacagaatagtgatgaaattcaatttaaaaaatcacgttagcctccaaaccatttaattcaaatgaacccatcaactggatgccaactctggcgaatgtaggacctctgagtggctgtataattgttaattcaaatgaaattcatttaaacagttgacaaactgtcattcaacaattagctccaggaaataacagttatttcatcataaaacagtcccttcaaacacacaattgttctgctgaagagttgtcatcaacaatccaatgctcacctattcagttgctctgtggtcagtgtggctgcataacagtggattccatgaaaggagtcattttagtgatgagctgccagtccattcccaggccaggctgtcgctggccatccattcagtcgattcagtcataggcgaatctgttctgcccgaggcttgtggtcaagcaaaaattcagccctgaaatcaggcacatctgttcgttggactaaacccacaggttagttcagtcaaagca

SEQ ID NO: 255 - DNA, 97 bp, Homo sapiens
ggtggagctgcctcataatctgcttttttgctttggtggcccctgtggcctgggtgggccctcccgcccctccctggcaggacaatctgcttgtgtc

SEQ ID NO: 256 - DNA, 41 bp, Homo sapiens
ggcggtgctacagattgatcaagtgcatgaactcggtggag

SEQ ID NO: 257 - DNA, 83 bp, Homo sapiens
gccaggaggatatgcctcataaccagttcatcaagatgatgatcatcttttccatcgccttcatcactgtccttatcttcaag

SEQ ID NO: 258 - DNA, 110 bp, Homo sapiens
gttccccctgatgacgctgcagctgctggacttctgcctgagcatcctgaccctctgcagctcctacatggaagtgcccacctatctcaacttcaagtccatgaaccaca

SEQ ID NO: 259 - DNA, 91 bp, Homo sapiens
aaatcatggactatctcctgtgcctgctcaccctgctgggctcctacattgagctgcccgcctacctcaagttggcctcccggagccgtgc

SEQ ID NO: 260 - DNA, 41 bp, Homo sapiens
tcttcatcatcagcctgagcctactgatcggcgtagtcaag

SEQ ID NO: 261 - DNA, 52 bp, Homo sapiens
gggctttcctgtgcatcctcatgtccccaaaccagtggttccccaagtgtgg

SEQ ID NO: 262 - DNA, 65 bp, Homo sapiens
acccccgcttgtccactgtccgccagacctgctgctgcttcaatgtccgcatcgcaaccaccgcc

SEQ ID NO: 263 - DNA, 27 bp, Homo sapiens
tgtctcagaggaggggacggcagcacc

SEQ ID NO: 264 - DNA, 25 bp, Homo sapiens
ctatgccttcataccattctcagct

SEQ ID NO: 265 - DNA, 30 bp, Homo sapiens
cccttgagattctccagggaaagttctgaa

SEQ ID NO: 266 - DNA, 25 bp, Homo sapiens
ctgtgtttatcaatatttgggctct

SEQ ID NO: 267 - DNA, 62 bp, Homo sapiens
atgtgcatcaaggaatgcctccgcctctacgcaccggtagtaaacatatcccggttactcga

SEQ ID NO: 268 - DNA, 44 bp, Homo sapiens
gatgaaatcagggaactcctaggggatgggtcttctattacctg

SEQ ID NO: 269 - DNA, 27 bp, Homo sapiens
taccctgagcatcagcagagatgctga

SEQ ID NO: 270 - DNA, 31 bp, Homo sapiens
ctgaagtgaaaacgttcatgtttgcaggaca

SEQ ID NO: 271 - DNA, 36 bp, Homo sapiens
tactactcagaaaagacgccaggattttctggacat

SEQ ID NO: 272 - DNA, 123 bp, Homo sapiens; identical to SEQ ID NO: 32

SEQ ID NO: 273 - DNA, 62 bp, Homo sapiens; identical to SEQ ID NO: 31

SEQ ID NO: 274 - DNA, 102 bp, Homo sapiens; identical to SEQ ID NO: 30

SEQ ID NO: 275 - DNA, 32 bp, Homo sapiens; identical to SEQ ID NO: 29

SEQ ID NO: 276 - DNA, 70 bp, Homo sapiens
aggagatggacgatcagagccatgcacctgtttcctgcaccccctgcgcactggttctatggccacaagg

SEQ ID NO: 277 - DNA, 70 bp, Homo sapiens; identical to SEQ ID NO: 28

SEQ ID NO: 278 - DNA, 305 bp, Homo sapiens
gacaacccgggatcgtttgcaagtaactgaatccattgcgacattgtgaaggcttaaatgagtttagatgggaaatagcgttgttatcgccttgggtttaaattatttgatgagttccacttgtatcatggcctacccgaggagaagaggagtttgttaactgggcctatgtagtagcctcatttaccatcgtttgtattactgaccacatatgcttgtcactgggaaagaagcctgtttcagctgcctgaacgcagtttggatgtctttgaggacagacattgcccggaaactcagtctattta

SEQ ID NO: 279 - DNA, 109 bp, Homo sapiens
gtgagtcacgcttcctgattcctcggcgcaaaggagacgtttatcctttcaaattcctgccttccccctcccttttgcgcacacaccaggtttaatagatcctggcctc

SEQ ID NO: 280 - DNA, 29 bp, Homo sapiens
taccggatttcggtatcgtcccagaccca

SEQ ID NO: 281 - DNA, 50 bp, Homo sapiens
tcggggaagtacaagaaggtggagatcaaggaactgggggagttgagaaa

SEQ ID NO: 282 - DNA, 99 bp, Homo sapiens
gttctccatgaagcgcctcaccgccggcctcatcgccgtcatcgtggtggtcgtggtggccctcgtcgccggcatggccgtcctggtgatcaccaaccg

SEQ ID NO: 283 - DNA, 43 bp, Homo sapiens
gtggagcgcacgctcatctattacctggacgagattcccccga

SEQ ID NO: 284 - DNA, 93 bp, Homo sapiens
aacacgtctcagaaggccgccggtgacgtggatatcggcgatgccgcctactacttcgagagggacatcaagggcgagtctctattccagggc

SEQ ID NO: 285 - DNA, 342 bp, Homo sapiens
ctgcacgtgtcccaccaacaagatgaccgtgtgcagccccgacggccccggcggccgctgccagtgccgcgcgctgggctcgggcatggcggtcgactgctccacgctgacctccaagtgtctgctgctcaaggcgcgcatgagcgcccccaagaacgcccgcacgctggtgcggccgagtgagcacgcgctcgtggacaacgatggcctctacgaccccgactgcgaccccgagggccgcttcaaggcgcgccagtgcaaccagacgtcggtgtgctggtgcgtgaactcggtgggcgtgcgccgcacggacaagggcgacctgagcctacgctgcgatga

SEQ ID NO: 286 - DNA, 249 bp, Homo sapiens
cttccctgttctgatcctatcgcgggcggcgcagggccggcttggccttccgtgggacggggaggggggcgggatgtgtcacccaaataccagtggggacggtcggtggtggaaccagccgggcaggtcgggtagagtataagagccggagggagcggccgggcggcagacgcctgcagaccatcccagacgccggagcccgagccccgacgagtccccgcgcctcatccgcccgcgtccggtccgcgt

SEQ ID NO: 287 - DNA, 169 bp, Homo sapiens
ggaaatctcataagctggtaccactcaggagaagtttattcttccagatgaccagcagtagacaaatggatactgagcagagtcttaggtaaaagtcttgggaaatatttgggcattggtctggccaagtctacaatgtcccaatatcaaggacaaccaccctagcttc

SEQ ID NO: 288 - DNA, 182 bp, Homo sapiens
aagctgagtctgcacaggcttcagcaaaaatgttgcaggaaatgcaaagaaagaatgagcagatgatggaacagaaggagaggagttatcaggaacacttgaaacaactgactgagaagatggagaacgacagggtccagttgctgaaagagcaagagaggaccctcgctcttaaacttcag

SEQ ID NO: 289 - DNA, 116 bp, Homo sapiens
gactggataaacatgggaccctttaactagagcaagatccacaaaggtgtgtcttacttgccgaggtcatctctgagtagggcatatgcagtcagcaacaacgacaggtaagtgta

SEQ ID NO: 290 - DNA, 26 bp, Homo sapiens
tatgactgatgcaattctccagacag

SEQ ID NO: 291 - DNA, 341 bp, Homo sapiens
tggaaagctgctgacctgcctcctacaaacaccaaggtgaccaagcttcactgcatacagatgtgcttttttgtttgcataacattcatgcttttattcaataacatatgcaaacaggctgttataccagatatgtcctaggtgctcatcaaagagagtgcagtcaattaactattaagttataaattcaattagcagatgaagcacaaagttattattgtcatcattacagctgggcttttcctgttgcaagagacaggaacccaatgatggctgcttaaacaaaaatgtaattcattgatttaggctgcaaactggctttacaggtcaggtgggtctaa

SEQ ID NO: 292 - DNA, 150 bp, Homo sapiens
tgaaacttttaacctgcccagactctgtatccggaaattcttcccaaagaaaaaatgctttgtctttgatcggcccgttcaccgcaggaagcttgcccagctcgagaaactacaagatgaagagctggaccccgaatttgtgcaacaagt

SEQ ID NO: 293 - DNA, 28 bp, Homo sapiens
ggtttgtgatcttctacttagccataga

SEQ ID NO: 294 - DNA, 245 bp, Homo sapiens
gagagcttcaactgataaatgaggatgagaaaacacaagaaattatcatttttcagtttactattgctagttttccagcatttgcagttttctatgtcttcagctggctattcctagaaattaatacttgctgaatatccaaattaatagatgttattttaaattacatttgtcattgttctagaacaagtttcttgttctttcacctttgtgtatgctgtgattaggttaattttatctccctg

SEQ ID NO: 295 - DNA, 183 bp, Homo sapiens
gacacatagaatccgatcaaaatcctcacctgatgagaatgagaatgaggttgaggattcagctgactttgtgagcttcttcccagactttgtgtggacactgagagatttctccctggacttggaagcagatggacaacccctcacaccagatgagtacctgacatactccctgaagctgaa

SEQ ID NO: 296 - DNA, 47 bp, Homo sapiens
atcccatgtatccactttagaactgacactgacacttaggttaggag

SEQ ID NO: 297 - DNA, 29 bp, Homo sapiens
ctgagcagcaccttcgtgtacaatagcat

SEQ ID NO: 298 - DNA, 91 bp, Homo sapiens
gtgcagtctcacactaaaggaatctggatgtggtgtgtgccccaccccaagaagccaggccacatcctagttctgctggacaccgagggtc

SEQ ID NO: 299 - DNA, 32 bp, Homo sapiens
agcacaaattatgcctctcctaaaaggagtaa

SEQ ID NO: 300 - DNA, 25 bp, Homo sapiens
atctacacagtcagcctccattatg

SEQ ID NO: 301 - DNA, 42 bp, Homo sapiens
gagaacactaatgggcgactgatggcgaatccagaagctctg

SEQ ID NO: 302 - DNA, 28 bp, Homo sapiens
atggcatcagagatccacatgacaggcc

SEQ ID NO: 303 - DNA, 29 bp, Homo sapiens
ctgagcagcaccttcgtgtacaatagcat

SEQ ID NO: 304 - DNA, 808 bp, Homo sapiens
ggccatagactagctctgatctgtggcctcttaggaacccggccacacagcaggaggtgagcagcaggtaagtgagcattacagcctgagctccacctcctgtcagatcagcagtgacattagattctcacaggagtgggaaccctattgtgaactgtgcatgcaaaagatctaggttgtgtgatccttgtggaacaatataaaccagaaaccaataacgccaccccacctccaacccccgccaaccctctgtggaaaaattaccttccacgaaactggtccctgatgccaaataggttgggggaccgctgacctagagggagttatgcacatgggcttataaggttagccaagagaaaggacaagaagacccaaagtcggcaagcaaatttattaacctgctgggctgctctacagaaatctgaggaggcagacaccgggcttacaggctaaggggtataagtaggtctgcaggggttttgtgtgtgtgtgcgggggtgtcgggggggcaaggccatttgtggagacttttcctcccagtatggccacatcctgcagtttgtcagtttttgcccccgcctggctcagggtaccaggatgtggtttagcttaggggtggttatagtggcacctaagttctgggaacttgcggtgggggcgaccttttggacgaaaaataagctgcagggcagctaggggagggggcttgttatattcctctgggggcagggtgtccctaactgggctcagtcggaaggaacttgaccaaagtctgggctcagttgggcatcactcaggctaatggtcg

SEQ ID NO: 305 - DNA, 92 bp, Homo sapiens
agtgctaaatatgggagtttcctttttttactctttgtcactgatgacacaacagaaaagaaactgtagaccttgggacaatcaacatttaa

SEQ ID NO: 306 - DNA, 74 bp, Homo sapiens
gcacaacattccaagctcaaaatagaagccttctcagtgagctccagcacgcccagaggactgttaataacgat

SEQ ID NO: 307 - DNA, 97 bp, Homo sapiens
gtattcatcaattgtttcatctctcccctgcctgtaacgatgagagtatgtagcagtggcaaagagggagaggcagcaagatcttgtggctctcagc

SEQ ID NO: 308 - DNA, 88 bp, Homo sapiens
agcgcaaaggttggcggcgattcaaaggcagaacgagcaaatgatgcaggagagggagagactccatcaggaacaagtgagacaaatg

SEQ ID NO: 309 - DNA, 161 bp, Homo sapiens
ccctcatgggatgttaaactagagcaagaatggcaaagatgcttcttagctcctcaagcatatctgactggcatgatcctgcattgtggttacctggaagggaaaaacaacccctgggaattttatccaggaagttggaacaatcacaaacaaaagtggga

SEQ ID NO: 310 - DNA, 34 bp, Homo sapiens
tgcaatattacagactgaccaggctctcacagag

SEQ ID NO: 311 - DNA, 782 bp, Homo sapiens
gttggtgttcctcgcacagaatttatatctaatggtagcagtggggttaaactgaaccatcaccataatcaccagacttgctttgtgaccatcaacattcattgcaacaaagaggcctttttggttacattggacagaatgccaatacttgaaactaacctaagaaacaccagtaattcattggcttacacaaactaaaagcaaaagattttaatttagtttcaagtatagatgcattcagaattttaaacaatattatcccttttcctccttctttctgtcatttttctgtttcattttcctgactattggcttcatttccaggcaggctcaccccacatgacaataaaggtgacaccaacaggtccaagcttaactagtccttactgccctcagtctcaggggaaagagagcatcttttctccagcatatatctgtcattcaaacacaaaagcatcatcaattttcatactctttgcagtatttttctccctgtgaacaagtcctttgcatctagtggacttgcatgctctgactgaccatggagtcatggccaaacttgtgacaggagcaggtgttccacaagcctctccagtctcaattggcagttccaccaagtgcagggtggaagcctgtataggctccacctctcctatggagcctctcctatggcaagcctctcctatgaggaatagatgctgctggaaggaacaagacaaagatgtttacaacattcctaatcaccatttcctgcatctaactgcatgttttccgggttgcta

SEQ ID NO: 312 - DNA, 165 bp, Homo sapiens
ggaacctggaagcatcctcggattattgctcggctttacttaaggatatttttggtcctctagaagaagcagtgaagcagggaatttattctaagccaggaggccataatctcttcattcagaaaacagaagaactgaaggcaaagtactatcgggagcctcgga

SEQ ID NO: 313 - DNA, 218 bp, Homo sapiens
gccttgcatagagaatgcagtcctggccttggctcagagagagaactcagctgcagtgcaaaaggccattgcccactatgaccagcaaatgggccagaaagtgcagctgcccatggaaaccctccaggagctgctggacctgcacaggaccagtgagagggaggccattgaagtcttcatgaaaaactctttcaaggatgtagaccaaagtttccaga

SEQ ID NO: 314 - DNA, 57 bp, Homo sapiens
tgttcctacatctttagccattctatgaccaagactcttccaggtggcatcatggtc

SEQ ID NO: 315 - DNA, 34 bp, Homo sapiens
tgatgagctagagcctgaatttgtgcaacaagtg

SEQ ID NO: 316 - DNA, 33 bp, Homo sapiens
aaatgctttatctttgacttacctgctcaccaa

SEQ ID NO: 317 - DNA, 34 bp, Homo sapiens
tcaaaatttcaatttgccccgtctgtgtatacag

SEQ ID NO: 318 - DNA, 26 bp, Homo sapiens
ctggaaatagatgggcaacttgtcac

SEQ ID NO: 319 - DNA, 57 bp, Homo sapiens
actgacagatctgctcaaggcaagaaactcacccgaccttgacagggttgaagatcc

SEQ ID NO: 320 - DNA, 87 bp, Homo sapiens
gatctttgcactggcactcttactgagcagcacctttgtgtacaatactgtgaacaaaattgatcagggtgctatcgacctactgca

SEQ ID NO: 321 - DNA, 106 bp, Homo sapiens
ctctgttgcatctacggtgcagtctcacaccaagggaatttggatatggtgtgtgcctcatcccaactggccaaatcacacattagttctgcttgacaccgagggc

SEQ ID NO: 322 - DNA, 45 bp, Homo sapiens
tctgccattacgcaacctgtagttgtggtagcgattgtgggcctc

SEQ ID NO: 323 - DNA, 65 bp, Homo sapiens
tggctttagagatccacatgtcagaccccatgtgcctcatcgagaactttaatgagcagctgaag

SEQ ID NO: 324 - DNA, 996 bp, Homo sapiens
gggtcaggcttgcactaggcatttcctgactcccatgtcctagtgctacaccatttgcaaatggatatcctattttctgctgccaagcagtttctgttttaatttatgtcaacataatgatttccagggcattagctatgaggaagcagggagaatgggtcttcataattgtaaaatgacagtttttgaaatttgctagtaaagagatggagaatccaaaccttttcattgtaagattttagtgaaagaactcgtcaagcggatagtgaagttttagcatccttagtaaataaccacctttaaaatggaagaaaactatcctttatgataaggcaaagtagaaaagcatatttttatggcatttgctttttctcatatagctcaaacattttttttaaccagagactctttaggttatagggattgatgctcagaagttagaaaaaaataggttaagtattattaaaggaagttgttttactcattcagtcaatcataaaataatcatgctttgaagttttggtttaataaagcacattagtaactatgtaaaaaatttcaagtatatcactaagaagcaaacagctatgatttgttagataatgctgcataatgacttggtagtatttaatgtaatgcagtttgactggacatagatctaactgaaaaaaatgaagttgacacaaagtaaaaggaacagtgtaatatattaataaagaacatcataaagaattaatataggaacccagggaggtaaaaactaaaaaacataactaagccaaaaaccaatggaataagagttagattcaaactagtaggttagacgcaggaaatggattttcgtatgcctatcaaatatttaagaaccagtagaatggcctatagtagacatataaagggcctaggacttacttttgttttaaaataaagtctctctattttacaggactctttttattttaaaactttttttttccagaaacttaggcagtgctg

SEQ ID NO: 325 - DNA, 104 bp, Homo sapiens
ctaattgttgtagatcatcacttcaaggtgcccatatctttctagtggaaaaattattctggcctccgctgcatacaaatcaggcaaccagaattctacatata

SEQ ID NO: 326 - DNA, 640 bp, Homo sapiens
tgcccaactggatccctcaatactgtctggcaactgttcactcgttgaaattctctcctttgaatttcttaccatgacacatacttcaagcattttgtactagtttgatttccatttatatccttaataagagccttttccttttccttgaaattcaaaccagaaactatgcaaaataagcaaaagcaagcaataacaactacatatacaaatgcaggcgcaaaacccaaactagaatcatatggctgaaaacagatgttttctttcagaaatccttccactaccacttctgagcattttctcttagtatttttttttgggcattttccttctttgcactttttaaaatctcctgcagctcgctcactctctttcataagccagcagttatactgatgttaataaatagttgtttatttacttttgcttttttagaaaacaagctgaaagaattgagtgaaatgccagagagatacagatagccagttgtagggctggggttggaaatcaagtctaatttaaggcaagggcaaaatgtgcattttgtgtgtgtattttgaaccattcttgcattgtttttatttgcaaaggttatagggctcaagcagttagggagaatgcatcccagaacactaagtta

SEQ ID NO: 327 - DNA, 46 bp, Homo sapiens
tgatagctattattttcatgagaaagaacaatgaatatgatgcaat

SEQ ID NO: 328 - DNA, 116 bp, Homo sapiens
tctacaaaggataggatgcagcttatcctgatgtggtatatcagacctcagtaaagaataaattgtattcttatcagacaggcagcagaattcatcaagtaccagctgtgtctgcc

SEQ ID NO: 329 - DNA, 26 bp, Homo sapiens
aatatactttaaataaaggtgactgg

SEQ ID NO: 330 - DNA, 603 bp, Homo sapiens
gagtaaccaggtcgtccaagcaaaaacaaatgggaaaatgtcttaaaaaatcctgggtggacttttgaaaagcttttttttttttttttttttttttgagacggagtcttgctctgttgcccaggctggagtgcagtagcacgatctcggctcactgcaccctccgtctctcgggttcaagcaattgtctgcctcagcctcccgagtagctgggattacaggtgcgcactaccacgccaagctaatttttgtattttttagtagagatggggtttcaccatcttggccaggctggtcttgaattcctgacctcaggtgatccacccaccttggcctcccaaagtgctagtattatgggcgtgaaccaccatgcccagccgaaaagcttttgaggggctgacttcaatccatgtaggaaagtaaaatggaaggaaattgggtgcatttctaggacttttctaacatatgtctataatatagtgtttaggttcttttttttttcaggaatacatttggaaattcaaaacaattggcaaactttgtattaatgtgttaagtgcaggagacattggtattctgggcaccttcctaatatgctttaca

SEQ ID NO: 331 - DNA, 64 bp, Homo sapiens
tggagctgtggtatttgtggtcatcatccttgtcatcatcctggctatatctctacacaagtgt

SEQ ID NO: 332 - DNA, 121 bp, Homo sapiens
ctaatgagtttttgattgatgtggataaaggagaaaactactgtttcagtgttcaagcagtgattccctcccgaacagttaaccggaagagtacagacagcccggtagagtgtatgggcca

SEQ ID NO: 333 - DNA, 33 bp, Homo sapiens
tttatgacctgttttaaattgtgaatacttggg

SEQ ID NO: 334 - DNA, 128 bp, Homo sapiens
cggacagccaacaattcagagttttgaacaggtgggaacaaaagtgaatgtgaccgtagaagatgaacggactttagtcagaaggaacaacactttcctaagcctccgggatgtttttggcaaggact

SEQ ID NO: 335 - DNA, 94 bp, Homo sapiens
agacgtacttggcacgggtcttctcctaccctgcagggaatgtggagagcaccggttctgctggggagcctctgtatgagaactccccagagtt

SEQ ID NO: 336 - DNA, 25 bp, Homo sapiens
gtgacctcaccgacgagattgtgaa

SEQ ID NO: 337 - DNA, 101 bp, Homo sapiens
ctacaaatactgtggcagcatataatttaacttggaaatcaactaatttcaagacaattttggagtgggaacccaaacccgtcaatcaagtctacactgtt

SEQ ID NO: 338 - DNA, 298 bp, Homo sapiens
tcctgatccaatacagccgacggtgtgacaggccacacgtccccgtgggtctctgtggaagtttcagtgtagcgacatttcagataaaagtggaaaaagtgaagtttggcttttttcatttgtatgcagtcctaactcttgtcacacgtgtgggatttatctttttccataacttactgaaaacccttcctggcgggctgaacctgactcttcctgagctgagtcctggactggcacactgatggctctgggctcttcccggtcaagttataacaaggctttgcccatgaataatttc

SEQ ID NO: 339 - DNA, 51 bp, Homo sapiens
cgagaccgccgtcgctcggacgctcctgctcggctgggtcttcgcccaggt

SEQ ID NO: 340 - DNA, 45 bp, Homo sapiens
acgggcgccacggaacccgctcgatctcgccgccaactggtagac

SEQ ID NO: 341 - DNA, 442 bp, Homo sapiens
ccctggggctagatcgatgatatgaccagaaatcaaaaagggaatgcattatttattgctgtgtaacactgttaagagaggaggtagttaagggatggataggcacatagagagggaaggtctcaggagaagggatagaaaggaactatgttcacaagaacaacggcaagacagtgcctatactgcctctacagttaataggaaaaacggaagaagttacccttaagctaggatgttgctcagaagtgaccatcccaactttggtgcgggcacaataaatcagcctaaatgtccctaatttaacccagctcattataatgtcattaaacatgacattagcattgtggttttagcacccccatgggttttgcttaggcactcatgggtaataaccaagatggagtccctttggcaaaacttaggcatgcacagctgtagtacc

SEQ ID NO: 342 - DNA, 169 bp, Homo sapiens
gcccaaatggcagggatacccagtgatgtcaggaggaatagtacagacagaaggtgctaagcagacaattcaactgccatgttttgccaccccctgtgagcagggattaggtgttcaggccagtatcttgggcatgggggagcctttggccagaagaggtataaagctc

SEQ ID NO: 343 - DNA, 1176 bp, Homo sapiens
tatgcatttcctgctggtcaagttgtaaattagtatagctactttggaggacaattgtaaaatttaaatcatatcctatgacccagcaattccatgctataaaaactcatccatggccgggcttggtggctcacgcctgtaatcccagcactttgggaggctgaggtgggcagatcacgaggtcaagagatcgagaccatcctggccaacatgatgaaaccccgtttctactaaaaatacaaaaattagctgggcatggtggcatgtgcctatagtcccagctactcaggaggctgaggcaggagaattgcttgaacctgggaggcagaggttgcagtgagccgagatcacgccactgcactccagcctggctacagggcgagactctgtctcaaaaaaaaaaaaaaaaaaaaaaaaaaaacattcaaagagacatatactaagatgttcactgtggcattgtctgtaatgacaaataagtggaaaccgtgtaaatacctgtcaatactatggagtaccatgtggcaacggaagaatgagactgaactgtgtgaactaacatgcaaagatccccaaaacaggccaggtgtggttgctcacagctgtaataacaacaccttcagaggctgaggtgagaggatcagttgaggccaggagtttaagaccagcctgggcaacatagtgagacccctgtctcccaaaaattttttttaattagctgtgcgcaattgctcatgcatagtcccagctacccaggaggctgaggtgggaggatcacttgagcccaggaatttgaagctgcagtgagctgtgttcttgccactgcactccaatctgggtgactgagcaagaccctgtctcttaaaaaaataaaaaagatctccaagcatagagaagagtctggagggaaacaccaaactcataacagtcttactgcaggcaagtgggataaaggcccagactccatggtggaagttaaagggcatttccaagttaaggctaagacttgcttttctaactaagagaatgtgctcatgcattgcttgtgtagtagaaactagtttttagaaaagaaagcaaacttaagaaacactgactcctgtggagatgacttggcaccactctcctttcacagagcagagtctgaatagtcttcagagataggcctgtgggcca

SEQ ID NO: 344 - DNA, 26 bp, Homo sapiens
taaggcccaacattaaacacaaagct

SEQ ID NO: 345 - DNA, 287 bp, Homo sapiens
ctggtgtccagctgagtttctcttgggtataaaggctaaaagggaaaaaggatatgtggagaatcatcaagatatgaattgaatcgctgcgatactggcatttccctactccccaactgagttcaagggctgtaggttcatgcccaagccctgagagtgggtactagaaaaaacgagattgcacagttggagagagcaggtgtgttaaatgggactggagtccctgtgaagactgggtgaggataacacaagtaaaactgtggtactgatggacttaaccggagttc

SEQ ID NO: 346 - DNA, 25 bp, Homo sapiens
gtggggcaacaagcctgtatgctga

SEQ ID NO: 347 - DNA, 44 bp, Homo sapiens
gctttggagaaaatcgctgcctacttacagtctgatcagttctg

SEQ ID NO: 348 - DNA, 140 bp, Homo sapiens
tgggatcaatggttggacacctctagacctttaagtcttgggaagagcctaacttctataccttggaggcactgtctacaaaaaaatggaggaggtagacgcaggcaacacgtgaatgttgctgttctggtatgcatctg

SEQ ID NO: 349 - DNA, 77 bp, Homo sapiens
ttctcttataaaaacactcacaggctcccctgggacctgcaggatcccatagtggaggattcttccccggcttttgc

SEQ ID NO: 350 - DNA, 67 bp, Homo sapiens
ccgtatatttgaccccaagtgcctggatgagttcccaaacctgaaggctttcatgtgccgttttgag

SEQ ID NO: 351 - DNA, 31 bp, Homo sapiens
ggattttctcacctatgatatcttggatcag

SEQ ID NO: 352 - DNA, 93 bp, Homo sapiens
aaactgaagcctcagtacttggaagagctacctggacaactgaaacaattctccatgtttctggggaaattctcatggtttgccggggaaaag

SEQ ID NO: 353 - DNA, 71 bp, Homo sapiens
attcgagtggacatcatagagaaccaagtaatggatttccgcacacaactgataaggctctgttacagctc

SEQ ID NO: 354 - DNA, 41 bp, Homo sapiens
caatgccatcttgcgctacatcgctcgcaagcacaacatgt

SEQ ID NO: 355 - DNA, 55 bp, Homo sapiens
cgcctgctcctggagttcacggatacctcttatgaggagaaacggtacacgtgcg

SEQ ID NO: 356 - DNA, 324 bp, Homo sapiens
tgagtgccgtctcaacggtagagccgctcggtcaaagagactgacgcggagagggcgggtctctgggtccgcgatctccagcaggagcagctctacgcgggagccttttcgagctgccgagccacggatgtcgacccctgcccagcctctgggatcgcgggccctgtggggaggggcggaggagaccacgccggagccgggcctaggggccgcttaaccaccgccccggcaggacgcagggactcggcagccccgggccggggaacgttagcgggcgggggttgggaatgggtgggagctgcgcagtcgctgaaccgctgtctt

SEQ ID NO: 357 - DNA, 47 bp, Homo sapiens
atgtcgtgcgagtcgtctatggttctcgggtactgggatattcgtgg

SEQ ID NO: 358 - DNA, 150 bp, Homo sapiens
aacgccggcattagtcgcgcctgcgcacggccctgtggagccgcggaggcaagggacggagaacggggcggaggcggagtcagggcgcccgcgcgtgggccccgcccccttatgtcgggtataaagcccctcccgctcacagtttcccta

SEQ ID NO: 359 - DNA, 337 bp, Homo sapiens
cctgcgtttcttggaacccagaatacaaacccagcctaacatgcagcaagcctgctagaccttgtgggtcagagggctgggtccttgcctcacaggctgcctctgtccccttgcaattccattctatttctgccacatgccaagtgctatgacaggtacaaggcaaataagaacggtagaacacagcttcccccagcccacttccctgttctaaagacaccacatagacagagagcagcagacaggggccagcaggagctgtagttcagatcttcttggtcattccttgccgctgttatttgaacaaataaacacagcgcaaaggttaacaagtttt

SEQ ID NO: 360 - DNA, 300 bp, Homo sapiens
gcttcctgggaaacgtatgctagcagagcttctccccgtgaatcatatttttaagatcccactcttagctggtaaatgaatttgaatcgacatagtagccccataagcatcagccctgtagagtgaggagccatctctagcgggcccttcattcctctccatgctgcaatcactgtcctgggcttatggtgctatggactaggggtcctttgtgaaagagcaagatggagcaatggagagaagacctcttcctgaatcactggactccagaaatgtgcatgcagatcagctgttgccttc

SEQ ID NO: 361 - DNA, 82 bp, Homo sapiens
gtgacacaaacagccttttcccaggtacttggtacctggagcgagtggacgagcagcatcgccgaaagtatgcccggcgtcc

SEQ ID NO: 362 - DNA, 117 bp, Homo sapiens
tggacaagttggtgtccagcacatcagacctgccaaaacgcctagcctcccgaaagtgtgtgtctcctgaggagttcacagaaataatgaaccaaagagagcaattctaccataagg

SEQ ID NO: 363 - DNA, 77 bp, Homo sapiens
tccaggattggtgccttctcttatggctctggtttagcagcaagtttcttttcatttcgagtatcccaggatgctgc

SEQ ID NO: 364 - DNA, 28 bp, Homo sapiens
gtacgggtgcctggcctcgcttctgtcc

SEQ ID NO: 365 - DNA, 98 bp, Homo sapiens
caacaaggacctggataaagcacttctaaaggcctctcaggacatgttcgacaagaaaaccaaggcttccctttacctctccactcacaatgggaaca

SEQ ID NO: 366 - DNA, 137 bp, Homo sapiens
acccttgacgatttacagtacatgatctttcatacacccttttgcaagatggtccagaagtctctggctcgcctgatgttcaatgacttcctgtcagccagcagtgacacacaaaccagcttatataaggggctgga

SEQ ID NO: 367 - DNA, 92 bp, Homo sapiens
ctacaaaccaaatttggcctcggagtacccaatagtggatgggaagctttccatccagtgctacttgcgggccttggatcgatgttacacat

SEQ ID NO: 368 - DNA, 94 bp, Homo sapiens
gggcatgggacacagataatgaccagaaacctcctttatatggttctctcatcttttgtgctcaaggtaggctgcattgtgtagtctctgaaac

SEQ ID NO: 369 - DNA, 28 bp, Homo sapiens
gtggctatgctgattgggcccaaggccc

SEQ ID NO: 370 - DNA, 48 bp, Homo sapiens
tctgtggagacattgccgtctatcccagtggtaatgctcgtcccacag

SEQ ID NO: 371 - DNA, 44 bp, Homo sapiens
accaatgcctgctacggtggtactgcctccctcttcaatgctgc

SEQ ID NO: 372 - DNA, 34 bp, Homo sapiens
actcttccaggattcaggcaatactgatattgag

SEQ ID NO: 373 - DNA, 265 bp, Homo sapiens
acttggccaaaggacgtgggcatcctggccctggaggtctacttcccagcccaatatgtggaccaaactgacctggagaagtataacaatgtggaagcaggaaagtatacagtgggcttgggccagacccgtatgggcttctgctcagtccaagaggacatcaactccctgtgcctgacggtggtgcaacggctgatggagcgcatacagctcccatgggactctgtgggcaggctggaagtaggcactgagaccatcattgaca

SEQ ID NO: 374 - DNA, 86 bp, Homo sapiens
atgcagcgtctgttgactccagtgaagcgcattctgcaactgacaagagcggtgcaggaaacctccctcacacctgctcgcctgct

SEQ ID NO: 375 - DNA, 47 bp, Homo sapiens
ttctgctgggtttctgaactgctgggtttctgcttgctcctctggag

SEQ ID NO: 376 - DNA, 363 bp, Homo sapiens
atttcttccacgatggtgcagtgtaacgatgcactttggaagggagttggtgtgctatttttgaagcagatgtggtgatactgagattgtctgttcagtttccccatttgtttgtgcttcaaatgatccttcctactttgcttctctccacccatgacctttttcactgtggccatcaggactttccctgacagctgtgtactcttaggctaagagatgtgactacagcctgcccctgactgtgttgtcccagggctgatgctgtacaggtacaggctggagattttcacataggttagattctcattcacgggactagttagctttaagcaccctagaggactagggtaatctgacttctca

SEQ ID NO: 377 - DNA, 57 bp, Homo sapiens
acaaaggatatatcctcatggctcgaaataagaacaacgcctgtggcattgccaacc

SEQ ID NO: 378 - DNA, 38 bp, Homo sapiens
tgaaagctgcaatagcgataatctgaaccatgcagttt

SEQ ID NO: 379 - DNA, 145 bp, Homo sapiens
agagttgtatgtacaacccaacaggcaaggcagctaaatgcagagggtacagagagatccccgaggggaatgagaaagccctgaagagggcagtggcccgagtgggacctgtctctgtggccattgatgcaagcctgacctcctt

SEQ ID NO: 380 - DNA, 198 bp, Homo sapiens
ggcttttagctctgtgggtgccctggagggccaactcaagaagaaaactggcaaactcttaaatctgagtccccagaacctagtggattgtgtgtctgagaatgatggctgtggagggggctacatgaccaatgccttccaatatgtgcagaagaaccggggtattgactctgaagatgcctacccatatgtgggaca

SEQ ID NO: 381 - DNA, 104 bp, Homo sapiens
ccctgtctcattcccgcagtaatgacaccctttatatcccagaatgggaaggtagagccccagactctgtcgactatcgaaagaaaggatatgttactcctgtc

SEQ ID NO: 382 - DNA, 82 bp, Homo sapiens
agctttgctctgtaccctgaggagatactggacacccactgggagctatggaagaagacccacaggaagcaatataacaaca

SEQ ID NO: 383 - DNA, 90 bp, Homo sapiens
agctgacttccgcaatcccgatggaataaatctagcacccctgatggtgtgcccacactttgctgccgaaacgaagccagacaacagatt

SEQ ID NO: 384 - DNA, 123 bp, Homo sapiens
gcagaaatgagcagttcgctcctccctgataagagttgtcccaaagggtcgcttaaggaatctgccccacagcttcccccatagaaggatttcatgagcagatcaggacacttagcaaatgta

SEQ ID NO: 385 - DNA, 36 bp, Homo sapiens
tcttttccctaattgcgggcctcaccattgcatgca

SEQ ID NO: 386 - DNA, 56 bp, Homo sapiens
accctctggctgtggacaaaataatgaaggacctggaccagtgtagagatggcaaa

SEQ ID NO: 387 - DNA, 76 bp, Homo sapiens
tgtttacatttcacaaattcgctggggataaaggctacttaacaaaggaggacctgagagtactcatggaaaagga

SEQ ID NO: 388 - DNA, 273 bp, Homo sapiens
ccagacggacctcctagggctaatctgatagtgcctctgaggtcgataggactccacgtgccactccctgcagggtcatccagcaagtaattcctagacccgtaggtggccgcagagccggttacctctggttctgcgccagcgtgccccacccgcaggacggccgggttctttgatttgtacactttctaaaaccaaacccgagaggaagggcaggctcagggtggggatgccctgaaatattcgagagcaggaccgtttctactgaagaga

SEQ ID NO: 389 - DNA, 49 bp, Homo sapiens
tttcctcttagcctgtgatcggcctgtgatgatctctgatagcaaaagg

SEQ ID NO: 390 - DNA, 28 bp, Homo sapiens
tgccccgcgccaaagtgcccagagccat

SEQ ID NO: 391 - DNA, 39 bp, Homo sapiens
ctgagttactgggcccagaggctgggcccctggacatgt

SEQ ID NO: 392 - DNA, 75 bp, Homo sapiens
agttggatatcaacactgatggtgcagttaacttccaggagttcctcattctggtgataaagatgggcgtggcag

SEQ ID NO: 393 - DNA, 118 bp, Homo sapiens
agccttgaactctatcatcgacgtctaccacaagtactccctgataaaggggaatttccatgccgtctacagggatgacctgaagaaattgctagagaccgagtgtcctcagtatatc

SEQ ID NO: 394 - DNA, 40 bp, Homo sapiens
atgcaaattccctgccatgggattccccagaaggttctgt

SEQ ID NO: 395 - DNA, 161 bp, Homo sapiens
tgtctctgtgtgaatggacccttccccttcccacacgtgtatccctatcatcccacccttcccaccagagccatagccatctgctggtttggttatttggagagtgcaggccaggacaaggccatcgcttggggcatgaatcctctgcgtactgccctggc

SEQ ID NO: 396 - DNA, 150 bp, Homo sapiens
actgtctgggttggccccgcactttgggcttctcttggggagggtcagggaagtggagcagccttcctgagagaggagagagaaagctcagggaggtctggagcaaagatactcctggaggtggggagtgaggcagggataaggaaggag

SEQ ID NO: 397 - DNA, 32 bp, Homo sapiens
ctggccaagcctaaccgctataaaaaggagct

SEQ ID NO: 398 - DNA, 46 bp, Homo sapiens
actctggcagggagaagctgtctctgatggcctgaagctgtgggca

SEQ ID NO: 399 - DNA, 44 bp, Homo sapiens
ccccaccaatgggcctccagagaccccaggaacaataaaatgtc

SEQ ID NO: 400 - DNA, 152 bp, Homo sapiens
aagggcacaaattacctcgccgatgtctttgagaaaaaggacaagaatgaggataagaagattgatttttctgagtttctgtccttgctgggagacatagccacagactaccacaagcagagccatggagcagcgccctgttccgggggcag

SEQ ID NO: 401 - DNA, 119 bp, Homo sapiens
gagcaacactcaagctgagaggtccataataggcatgatcgacatgtttcacaaatacaccagacgtgatgacaagattgagaagccaagcctgctgacgatgatgaaggagaacttcc

SEQ ID NO: 402 - DNA, 34 bp, Homo sapiens
cagactgactactggctgaaagatctgctttggg

SEQ ID NO: 403 - DNA, 35 bp, Homo sapiens
actcatccttctactcgtgacgcttcccagctctg

SEQ ID NO: 404 - DNA, 894 bp, Homo sapiens
ggactcctagagtgattggacattcaaaatattcctgatagtcttgttaattaagagattaggatatctttccattaccttgataattacgttttaatttagcttttttcattggcctgtgtttaaatgcaaataaccccacaatggacatttcctatgttaaagtgacatttaggggataaaaaatgagagcagttccatggattttggtgtttcccctgagacatgaactcagcataatctgggataaaatgattgagtgttaaggatgtgtttgttgttcctgtcgtttttttattttcttcaaagtatacaacatggtttgatatgcacatacatttgtgtaatgattgccatggtcaattaacacatcaccatttttgtgtgtgtgtgtgtgtgtgtgtgtgagggagtcttgctccgttgccaggctggagtgcaatggtacaaccttggctcactgcaacctccacctcctgggttcaagcaattctcttgcctcagcctcctaagtagctgggactataggcgtgtgccaccatgcccagctaatttttgtatttttagtagagacggggtttcaccatgttggccaggatgatctcgatcccttgacctcatgatccgcccacctcggcctcccaaagtgctgggattacaggcgtgagtcactgcacccggccacatcacctcccatgttctatcttacgtattcagaacttgttcatcttgtaactgaaagcgtgtaccctttgaccaacactgtttttcctgtcttaacaggatctacagatcaaggacaggggaggggatagtggaggaaaacggagttagtctgtttctaaatgaggggacagtatgtttcttggggcctgaggacagcttaataaagta

SEQ ID NO: 405 - DNA, 150 bp, Homo sapiens
ggtgattcatggctctgtgaatttgaggtgaatggttccttattgtctaggccacttgtgaagaatatgagtcagttattgccagccttggaatttacttctctagcttacaatggaccttttgaactggaaaacaccttgtctgcattc

SEQ ID NO: 406 - DNA, 137 bp, Homo sapiens
ttctgtggaggatatactaagtgcgactttgccctatcctatttggaaatccctaacagaattgagttttctattaaggatccaaaaagaaaaacaaaatgctaatgaagccatcagtcaagggtcacatgccaata

SEQ ID NO: 407 - DNA, 295 bp, Homo sapiens
ggttcctaggctcctttgtacaacaggaaaatgcctcaaagccttgcttcccagcaacctggggctggttcccagtgcctggtcctgccccttcctggttcttatctcaaggcagagcttctgaatttcaggccttcattccagagccctcttgtggccaggccttcctttgctggaggaaggtacacagggtgaagctgatgctgtacttgggggatctccttggcctgttccaccaagtgagagaaggtacttactcttgtacctcctgttcagccaggtgcattaacagacc

SEQ ID NO: 408 - DNA, 147 bp, Homo sapiens
gctggtggcttaggccatcacccttcccttggctggaactactggacagacccttttgagatgtgcctgtggtgctgtggagatgtgtgtagtggtcttagctctttgttgagcttgtgtgtgtgttgtgtagtcttagctgtatgc

SEQ ID NO: 409 - DNA, 28 bp, Homo sapiens
gaaaagaaaactggaggctgggcgcagt

SEQ ID NO: 410 - DNA, 179 bp, Homo sapiens
ccttgtgtactgacgaccagggccagctgttctagagcgggaattagaggctagagcggctgaaatggttgtttggtgatgacactggggtccttccatctctggggcccactctcttctgtcttcccatgggaagtgccactgggatccctctgccctgtcctcctgaatacaagctg

SEQ ID NO: 411 - DNA, 218 bp, Homo sapiens
tatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaat

SEQ ID NO: 412 - DNA, 63 bp, Homo sapiens
gcctggtcggctcaccgcctatcatctgcatttgccttactcaggtgctaccggactctggcc

SEQ ID NO: 413 - DNA, 30 bp, Homo sapiens
attcaaacagacctcgtcattcctggtgtg

SEQ ID NO: 414 - DNA, 91 bp, Homo sapiens
gtcatcgtggcagccgtccttgtaaccctgattctcctgggaatcttggtttttggcatctggtttgcctatagccgaggccactttgaca

SEQ ID NO: 415 - DNA, 98 bp, Homo sapiens
tttgatcccctgtcagcctctgatactggagaatacagctgtgaggcacggaatgggtatgggacacccatgacttcaaatgctgtgcgcatggaagc

SEQ ID NO: 416 - DNA, 110 bp, Homo sapiens
ccaccattgggaaccgggcagtgctgacatgctcagaacaagatggttccccaccttctgaatacacctggttcaaagatgggatagtgatgcctacgaatcccaaaagc

SEQ ID NO: 417 - DNA, 111 bp, Homo sapiens
ccttcttgccaactggtatcaccttcaagtccgtgacacgggaagacactgggacatacacttgtatggtctctgaggaaggcggcaacagctatggggaggtcaaggtca

SEQ ID NO: 418 - DNA, 48 bp, Homo sapiens
gagtggaagtttgaccaaggagacaccaccagactcgtttgctataat

SEQ ID NO: 419 - DNA, 29 bp, Homo sapiens
gaagttgtcctgtgcctactcgggctttt

SEQ ID NO: 420 - DNA, 29 bp, Homo sapiens
ccttcggctcattttgaccctgtctgcag

SEQ ID NO: 421 - DNA, 38 bp, Homo sapiens
ggcattgggcagtgttacagtgcactcttctgaacctg

SEQ ID NO: 422 - DNA, 53 bp, Homo sapiens
acaaaggcgcaagtcgagaggaaactgttgtgcctcttcatattggcgatcct

SEQ ID NO: 423 - DNA, 36 bp, Homo sapiens
tccttcggcggctgttgtgtcgggagcctgatcgcg

SEQ ID NO: 424 - DNA, 38 bp, Homo sapiens
tcagtcccctcgctgtagtcgcggagctgtgtctgttc

SEQ ID NO: 425 - DNA, 1009 bp, Homo sapiens
ggaacctgtctcctaccacttcggagccatgggggcaagtgtgaagcagccagtccctgggtcagccagaggcttgaactgttacagaagccctctgccctctggtggcctctgggcctgctgcatgtacatattttctgtaaatatacatgcgccgggagcttcttgcaggaatactgctccgaatcacttttaatttttttcttttttttttcttgccctttccattagttgtattttttatttatttttatttttatttttttttagagatggagtctcactatgttgctcaggctggccttgaactcctgggctcaagcaatcctcctgcctcagcctccctagtagctgggactttaagtgtacaccactgtgcctgctttgaatcctttacgaagagaaaaaaaaaattaaagaaagcctttagatttatccaatgtttactactgggattgcttaaagtgaggcccctccaacaccagggggttaattcctgtgattgtgaaaggggctacttccaaggcatcttcatgcaggcagccccttgggagggcacctgagagctggtagagtctgaaattagggatgtgagcctcgtggttactgagtaaggtaaaattgcatccaccattgtttgtgataccttagggaattgcttggacctggtgacaagggctcctgttcaatagtggtgttggggagagagagagcagtgattatagaccgagagagtaggagttgaggtgaggtgaaggaggtgctgggggtgagaatgtcgcctttccccctgggttttggatcactaattcaaggctcttctggatgtttctctgggttggggctggagttcaatgaggtttatttttagctggcccacccagatacactcagccagaatacctagatttagtacccaaactcttcttagtctgaaatctgctggatttctggcctaagggagaggctcccatccttcgttccccagccagcctaggacttcgaatgt

SEQ ID NO: 426 - DNA, 192 bp, Homo sapiens
actccacgctgaccacggtgagggagatagaaacacagactgaactgctgtctccaggctctgggcgggccgaggaggaggaagatcaggatgaaggcatcaaacaggccatgaaccattttgttcaggagaatgggaccctacgggccaagcccacgggcaatggcatctacatcaatgggcggggacacc

SEQ ID NO: 427 - DNA, 52 bp, Homo sapiens
agccgagggccaccctgatagtctcaaggacaacagtagctgctctgtgatg

SEQ ID NO: 428 - DNA, 48 bp, Homo sapiens
gaccagggagaactccatccggaggctgcattcccatcacacggaccc

SEQ ID NO: 429 - DNA, 109 bp, Homo sapiens
tggacctagtgtcagcctcggtggtggtggtgggtgtgatcgccgcactcttgttctgccttctggtggtggtggtggtgctcatgtcccgataccatcggcgcaaggc

SEQ ID NO: 430 - DNA, 106 bp, Homo sapiens
tggatggggacactttgggctttcccccactgaccactgagcacagcggcatctacgtctgccatgtcagcaatgagttctcctcaagggattctcaggtcactgt

SEQ ID NO: 431 - DNA, 53 bp, Homo sapiens
aggcctctgtgaggggccttgaagaccaaaatctgtggcacattggcagagaa

SEQ ID NO: 432 - DNA, 252 bp, Homo sapiens
tcctggtccagcactagaagagggccagggcctgaccctggcagcctcctgcacagctgagggcagcccagcccccagcgtgacctgggacacggaggtcaaaggcacaacgtccagccgttccttcaagcactcccgctctgctgccgtcacctcagagttccacttggtgcctagccgcagcatgaatgggcagccactgacttgtgtggtgtcccatcctggcctgctccaggaccaaaggatcaccca

SEQ ID NO: 433 - DNA, 163 bp, Homo sapiens
cctcagacgtggtaactgtggtgctgggccaggacgcaaaactgccctgcttctaccgaggggactccggcgagcaagtggggcaagtggcatgggctcgggtggacgcgggcgaaggcgcccaggaactagcgctactgcactccaaatacgggcttcatgt

SEQ ID NO: 434 - DNA, 75 bp, Homo sapiens
ccctgtccctgggagccgagatgtgggggcctgaggcctggctgctgctgctgctactgctggcatcatttacag

SEQ ID NO: 435 - DNA, 243 bp, Homo sapiens
tcccaggtttctgccgtcgttgttggccacagcgtgggaagcagctctgggggagctcggagctcccgatcacggcttcttgggggtagctacggctgggtgtgtagaacggggccggggctggggctgggtcccctagtggagacccaagtgcgagaggcaagaactctgcagcttcctgccttctgggtcagttccttattcaagtctgcagccggctcccagggagatctcggtggaact

SEQ ID NO: 436 - DNA, 26 bp, Homo sapiens
aaccatggtaataaaatatgaatgat

SEQ ID NO: 437 - DNA, 27 bp, Homo sapiens
atgctactcttagatagaagatgggaa

SEQ ID NO: 438 - DNA, 161 bp, Homo sapiens
tactaaatgtactactgagcttcgctgagttaagttatgaaactttcaaatccttcatcatgtcagttccaatgaggtggggatggagaagacaattgttgcttatgaaagaaagctttagctgtctctgttttgtaagctttaagcgcaacatttcttgg

SEQ ID NO: 439 - DNA, 384 bp, Homo sapiens
ttgaggcaggaccatacagagtgtgggaactgctggggatctagggaattcagtgggaccaatgaaagcatggctgagaaatagcaggtagtccaggatagtctaagggaggtgttcccatctgagcccagagataagggtgtcttcctagaacattagccgtagtggaattaacaggaaatcatgagggtgacgtagaattgagtcttccaggggactctatcagaactggaccatctccaagtatataacgatgagtcctcttaatgctaggagtagaaaatggtcctaggaaggggactgaggattgcggtggggggtggggtggaaaagaaagtacagaacaaaccctgtgtcactgtcccaagttgctaagtgaacaga

SEQ ID NO: 440 - DNA, 34 bp, Homo sapiens
gggaaaagcccatgatcttcaagcagggaagccc

SEQ ID NO: 441 - DNA, 152 bp, Homo sapiens
tcccatgggggtaataagagcagtagcagcagcatctctgaacatttctctggatttgcaaccccatcatcctcaggcctctctacaagcagcaggaaacatagaactcagagccagatcccttatccaactctcgacttttccttggtctc

SEQ ID NO: 442 - DNA, 53 bp, Homo sapiens
agagactggaaggaccataaatttaaatggagaaaggaccctcaagacaaatg

SEQ ID NO: 443 - DNA, 25 bp, Homo sapiens
tcattctttccacctgggtaccaag

SEQ ID NO: 444 - DNA, 65 bp, Homo sapiens
tgacttctacattccaaaagccacactcaaagacagcggctcctacttctgcagggggctttttg

SEQ ID NO: 445 - DNA, 70 bp, Homo sapiens
ttcaaggaggaagaccctattcacctgaggtgtcacagctggaagaacactgctctgcataaggtcacat

SEQ ID NO: 446 - DNA, 123 bp, Homo sapiens
tagaaaccacgaattgccaggctgagcaataccagtcccgcccttcccctccctggtgtttacattgagttctccttcacaatttctgcagccactccgtggccaccgtcaccttattcctga

SEQ ID NO: 447 - DNA, 25 bp, Homo sapiens
acttcattgacgctgccacagtcga

SEQ ID NO: 448 - DNA, 41 bp, Homo sapiens
ctcccaaaggctgtggtgttcctggagcctcaatggtacag

SEQ ID NO: 449 - DNA, 32 bp, Homo sapiens
gctgctcctcccaactgctctgctacttctag

SEQ ID NO: 450 - DNA, 31 bp, Homo sapiens
ggctccggatatctttggtgacttgtccact

SEQ ID NO: 451 - DNA, 42 bp, Homo sapiens
gaaaggctgtttacttcctcctgtctagtcggtttggtccct

SEQ ID NO: 452 - DNA, 186 bp, Homo sapiens
agggcactcttgctgggatgctttctccagagcttatatatttcttcttactagaactttcttcccccttttattcccctctcttcttggactcatgagctgtctcttcatctctcctctctctcctgcatctctccccttactcttcaatttattctacttctggacctggacttacccaaactg

SEQ ID NO: 453 - DNA, 299 bp, Homo sapiens
atggagacattgtagaacctaacccatctactgtccttattgccagagtctcattgtcaccccctagaatttatggaaattggcccctcttttacaaagatggagataattgggtgattggggagaacctggtggaatcggtacccttgggtgctaatcccagctcttcctctctttgggagagggcttatcctctggaccccgttttctccacttacaaaatggggagactcctcagcattttctgaaatgcagacacatatgaggtcaaaggtggatgcgtgttttgacttctcaga

SEQ ID NO: 454 - DNA, 75 bp, Homo sapiens
agccgattctttacaaacctcaccactggcatctacaggttctaccccatctacatacagcctgaagacttcaaa

SEQ ID NO: 455 - DNA, 114 bp, Homo sapiens
tccatgtgttgagtgcctttgaccccctccccgtcagcccttctgatgacaaggccttgggctaccagctgctccgccagaccgtacagtccgtcttcccggaagtcaatatta

SEQ ID NO: 456 - DNA, 25 bp, Homo sapiens
aactcacgaagaacattgtggctga

SEQ ID NO: 457 - DNA, 46 bp, Homo sapiens
ccaggccacagtcaacttccggattcaccctggacagacagtccaa

SEQ ID NO: 458 - DNA, 64 bp, Homo sapiens
tcccttaaccaatgcaataatcaggaccaccacggcactcaccatattcaaagcaggggtcaag

SEQ ID NO: 459 - DNA, 71 bp, Homo sapiens
gagcagacaccaatgcctatcatatttggaagcgggacagtggtgactgtattgcagcaactggcaaatga

SEQ ID NO: 460 - DNA, 58 bp, Homo sapiens
gagaagggttccatgaacctcatgctgcaagtaaacatgacttcaggccactcttcag

SEQ ID NO: 461 - DNA, 92 bp, Homo sapiens
ccctgctacagtcaaggggcgtccagctagccttcattgtggacgaggggggcttcatcttggatgatttcattcctaacttcaagaagccc

SEQ ID NO: 462 - DNA, 41 bp, Homo sapiens
gctgatcaggaagtacatcccccgaagatctttcttcattt

SEQ ID NO: 463 - DNA, 212 bp, Homo sapiens
gtcagcaccagctttatccagcatgaagtcgtggaagagtatagccacctgttcactatccaaggctcggaccccagcttgcagccctacctgctgatggctcactttgatgtggtgcctgcccctgaagaaggctgggaggtgcccccattctctgggttggagcgtgatggcatcatctatggtcggggcacactggacgacaagaactc

SEQ ID NO: 464 - DNA, 80 bp, Homo sapiens
gccatccagattccaacagtgacttttagctctgagaagtccaatactacagccctggctgagttcggaaaatacattca

SEQ ID NO: 465 - DNA, 115 bp, Homo sapiens
ggtggctatgctgctcctagttttccctaccgtctccagatcgatgggcccgaggagcggggagcatcaaagggcgtcgcgaatcccttctcagttcagcaaagaggaacgcgtc

SEQ ID NO: 466 - DNA, 35 bp, Homo sapiens
aggtcagaactaccccggtagcctgacagcaggag

SEQ ID NO: 467 - DNA, 25 bp, Homo sapiens
caaacggccagtgttggttcttcag

SEQ ID NO: 468 - DNA, 59 bp, Homo sapiens
tggaaaaccctctcactgcagcgaccaaagcgatgatgagcatcaatggagatgaagac

SEQ ID NO: 469 - DNA, 25 bp, Homo sapiens
agagaaggtcatcaacagcaaagcc

SEQ ID NO: 470 - DNA, 1956 bp, Homo sapiens
tttgcctctgttgctctgaaatttccttttttctttgggcgtagtagttgccttttctaggatgaaagcactaacattctcctcctccaaagggatagttttagtaataacttcagtatttgcttatttgtttttgaggttttctttagaaggatgtgtggcagtggtctattaaaaaaattaagcaccagtgactcttgaacaactgcctgagtaaaattgaataaagcaagttaaattgtattcaaattcctgttgaaattatttgtgaaatattttagattaaaactttcagaaaatttaattaacgtttggctagccatgaaaaactttaaaaagacaccttttaaattgtcttgtgttttattatcaatcaaggaatgaaacatatttaaaggaagaatgatcatcacccagtatcccattatcgtgatgattgctttattcattgttttgatgtgtatgcaaattttatgtagcgtagttgtgttcacagataggatttggtagtgtactttcttctacttagtttgtttcataaacattttctctgtattttaatcttcataattatcctttggaagaggacttgtggcttttatcttttacttttcattatgggcattttcaaacataataaaaatagaaaaacagtataagcccacatgtatccatgaccagcctcaacagttatcaacacaattcctcttgtttgatttgttcttccctcttcttcaactttgagattaattcatgtttttattttatttatttttgctggaacattctgaagcaaactgtaaatatccttacaattgctgctatatctagttttcactattaagaagtcttaaggaacaactttctagactttttccgttttaggataaattcctgggagtgaatttatggttcagggttcaaacagttttattgatcttgaaatgtacagaattctcaatttgcctgtttcttgaagcttcagcctatatgatttctgggggctttgaaaattcattcattttacccactggaaatcatcttgtattgctcaaattatttatcaaaccaaaatttaattttataaaaagcagatgtgtctactgatgcaatgtaacaataggttttcttgggtgaaagagaaagccaggcccggcacagtggctcatgcctgtaatcgcagcgctttgggaggctgaggcaggtggatcacctgaggtcaggagttcgagaccagcctggccaacatggtaaaacccagtctctactaaaaatacaaaaattagccaagtgtggtggcgtgcgcctgtaatcccagctactcgggaggctgaggtgggagaatcgcttgaacccgggaggcggaggttgcagtgagcctagatcacgccattgcacaccagcctgggccataagggcaagactctgtctcaaaaaaataaaaaattaaaaaaaaaaaaaggagaaagccaaatggcataggtggtaggaaaagtggtgaccaagtaataatagctcatacttcttgaagactgtgtgtcaggcattattatacaccttttagtgtatcatctcatctcaacctgatgagaatggatgccattattgtccccattttgcagatgaggattcagttactaagagatgaagtaacttgctcaggtgacacagaacttgaacccaggcaatttgaccctggcgtctatgctgtaaccccagttgatcagatcgcatagcttcaggtttctagtaaaacacagtaattgtttttaggattatggaaagtaaagcttgttagaggagagctctgagcccttagtatttcgaatgaaattttacttaataggtttggattttatttgaccgataaccagaaagcctttttccctttatctagtaatgggtagttttgatgttttctgtttattctgtcaagtgttattgcacaggacccaa

SEQ ID NO: 471 - DNA, 100 bp, Homo sapiens
aaacagcataccaattgtgacagagcagcccctcatctctgctggagaaaacagagtgcaagtactgaaaaatgtgccatttaacattgtccttccccat

SEQ ID NO: 472 - DNA, 55 bp, Homo sapiens
ctgggcattgataagagaggccatctgacagctccagatacgacagtcactgtct

SEQ ID NO: 473 - DNA, 30 bp, Homo sapiens
tgcctacccactccatcaagacagaaaccc

SEQ ID NO: 474 - DNA, 95 bp, Homo sapiens
ggtggtggttttcgatcggaatctcaatactgaccagttcagctctggtgctcaagccccaaatgctcaaaggcgaactccagactcgaccttct

SEQ ID NO: 475 - DNA, 61 bp, Homo sapiens
ccctcggatctcagtctgcggatgcctggcatgaattcagaggactatgtttttgacagtg

SEQ ID NO: 476 - DNA, 33 bp, Homo sapiens
gaacaactttgaatataccctagaagcttcaaa

SEQ ID NO: 477 - DNA, 94 bp, Homo sapiens
agccaggagacagtaccatgacgtacctgaacaaaggccagttctatcccatcaccttgaaggaggtgagcagcagtgaaggaatccatcatcc

SEQ ID NO: 478 - DNA, 77 bp, Homo sapiens
gcagagaagatcagttaaggcattggaagtactggcactcccggcagcacaccgctaaacaaagatgcattgacata

SEQ ID NO: 479 - DNA, 877 bp, Homo sapiens
caagagcccgcttttattcccagaggtgcagccatccagttttctaaatccaattatttttggcagtgatcagcttcctgccgaaagcatttgaatttttatgccagctactgatctgttccaaacactgtcctcggcctcctggaaccagtgctctcaccattgctcccatgcagtaatgggacatgtgcccacgtggtggctttccacaggacactagggccagaagccatgtagctggctaacctgagaatgtccccactgttcagtctgcaattgctttaaggggtaatatcttctttaaaagattctgattattatttggagatgatggaggtagagaaaaaaacaagtaaaagaaagatattgctgctgtgcagttgcctaacagtcttccctagtcacgtgctaaaccgtgtaactaacctctctgtgggctgtagtggcaaacctgtgcaaatctgtatttactgaagtagcgttacacagacctctgttcttgccatgtatgtaattttcatgtaaaaccattgtctgtatcacagatggctgtttaatattagtgttactttttttctttaccttttgtaatgctcttgtttccttttcaggagaatgagaactcagttctaatcttggttctacagagtagttttgtgaccttgggactgttatttaaactttttagacttaaatttcctaattgtgacataatgagattgaattaaatatgtctaagcttgcctctattacaaaaactctgtgattctttttcttcgtattttgaacttcttctaatcgaacaaaatgttaatttaaattgtccagaggtgataatgctaaaaactagatcttattttgaactgctgggatccca

SEQ ID NO: 480 - DNA, 63 bp, Homo sapiens
aaagaaagcttcaacactatcagtaacatcgaggagattgcgtataacgccatttccttcaca

SEQ ID NO: 481 - DNA, 545 bp, Homo sapiens
gggcgccttatgtccagccatttgagaaatgggaggagtttaatgatttgacaactgatttttttttttttcacagttttatgtgtttcattctcaggtgttatgaaactatcctcttccctttttattctcccctcctccaaaacagatcatttttgttgccatcctttgcacagagtccagtgtgtgaaacattgagattaagttgcactctgccactcctgcctgttcagccttgagtctgactcctcatttgctttgcctcatttcctcatttgcacagtggaggtgatatctgtctcctccctctattgaaggaggtgtaaggagtaatgaaacaatgcccatcaaactgttggagtggctttgagaaaggctcttaaatataagtgattattagtagtactctgtttcatatcatcaccttgtaaatatgactctgtgttaagattcttctgtcttgggcttttcccattgaagagttgcctccagttcagttggagtaactctaattggctagagttactccttgtgggcgactctaa

SEQ ID NO: 482 - DNA, 91 bp, Homo sapiens
aggggttgcctcttaacattcaagttgatacctatagttacaacaaccgcagcaacaagcctgtgcaccgggcctactgccagatcaaggt

SEQ ID NO: 483 - DNA, 28 bp, Homo sapiens
gcggaaaatcagggatgaagaacgaaag

SEQ ID NO: 484 - DNA, 25 bp, Homo sapiens
tgatgttaaagtgccactgcttccc

SEQ ID NO: 485 - DNA, 32 bp, Homo sapiens
ttcccattgcctctgaagaattggagggtgaa

SEQ ID NO: 486 - DNA, 72 bp, Homo sapiens
ggccgtacggcacagaagatgactttgctgtccctccttctaccaagctggcccggatagaagaaccaaaga

SEQ ID NO: 487 - DNA, 80 bp, Homo sapiens
tgctgctctacgttcgaaaggagtcagaagaagtctttgatgccctgatgctcaaaaccccatctttgaagggcttgatg

SEQ ID NO: 488 - DNA, 32 bp, Homo sapiens
atctcagacaaatacgatgttccccatgacaa

SEQ ID NO: 489 - DNA, 105 bp, Homo sapiens
aacatggacgacaacattgtgaagcattactccaatgaggacaccttccagctgcagattgaagaagccggggggtcttacaagctcaccctgacggagatctaa

SEQ ID NO: 490 - DNA, 503 bp, Homo sapiens
catgtcgccagcacaggtctatgtcgagggaatgggttccttgcaggttggaggcggggctgcatctggcttggtggtagcatttaatctattgcattggtgtttttcagatgaaagagaaatccatataccattatgtttgaatttcctgatatatacaggatttaaagtgaaaactttattccaagagttaacagagtctctgggaagctttaggacatctgctacgttatttatcaaaatattgggatctctgccttgtgcctacagtgtcgtgggcctgctcgctagcagaagtcagaaaaggcgataggcttggctttaaggatttcgtgcccttgcctgaattcagtacaactccactgcctcacgttagcgggagcgcacctgaagagtacggggggagccctctctcccttaccctctcactctccaccagatgtttactaaacagggcatgttactgaaatcttcctttgcgactttctcggacatatcaactg

SEQ ID NO: 491 - DNA, 244 bp, Homo sapiens
gagcagcgctcctccggttaaaaggaagtctcagcacagaatcttcaaacctcctcggaggccaccaaagatccctaacgccgccatggagacgaagcacctggggcggggcggagcggggcgcgcgggcccacacctgtggagagggccgcgccccaactgcagcgccggggctgggggaggggagcctactcactcccccaactcccgggcggtgactcatcaacgagcaccagcggccaga

SEQ ID NO: 492 - DNA, 138 bp, Homo sapiens
gcgcacagagcgctagtccttcggcgagcgagcaccttcgacgcggtccggggaccccctcgtcgctgtcctcccgacgcggacccgcgtgccccaggcctcgcgctgcccggccggctcctcgtgtcccactcccgg

SEQ ID NO: 493 - DNA, 25 bp, Homo sapiens
gcccctcttctcggcgcgcgcgcag

SEQ ID NO: 494 - DNA, 61 bp, Homo sapiens
caggtcctcgcgttcgggcttctgcttgccgcggcgacggcgacttttgccgcagctcagg

SEQ ID NO: 495 - DNA, 27 bp, Homo sapiens
gtgaggcgcggattggagcagagttgt

SEQ ID NO: 496 - DNA, 27 bp, Homo sapiens
caagaggccgcgctttccagcgtggag

SEQ ID NO: 497 - DNA, 69 bp, Homo sapiens
caagctggccgtaaactgctttgtgaataataatcgtcaatgccagtgtacttcagttggtgcacaaaa

SEQ ID NO: 498 - DNA, 26 bp, Homo sapiens
tggctgccaaatgtttggtgatgaag

SEQ ID NO: 499 - DNA, 98 bp, Homo sapiens
gaaggggccctccagaacaatgatgggctttatgatcctgactgcgatgagagcgggctctttaaggccaagcagtgcaacggcacctccatgtgctg

SEQ ID NO: 500 - DNA, 27 bp, Homo sapiens
gtgtgtgaacactgctggggtcagaag

SEQ ID NO: 501 - DNA, 48 bp, Homo sapiens
tatgagaataatgttatcactattgatctggttcaaaattcttctcaa

SEQ ID NO: 502 - DNA, 91 bp, Homo sapiens
ttaaaggtgaatccttgtttcattctaagaaaatggacctgacagtaaatggggaacaactggatctggatcctggtcaaactttaattta

SEQ ID NO: 503 - DNA, 62 bp, Homo sapiens
gtctaaaagctggtgttattgctgttattgtggttgtggtgatagcagttgttgctggaatt

SEQ ID NO: 504 - DNA, 33 bp, Homo sapiens
atgggtgagatgcatagggaactcaatgcataa

SEQ ID NO: 505 - DNA, 152 bp, Homo sapiens
tgcgtgggacgaagacatctttgaaggtcatgagtttgttagtttaacatcatatatttgtaatagtgaaacctgtactcaaaatataagcagcttgaaactggctttaccaatcttgaaatttgaccacaagtgtcttatatatgcagatc

SEQ ID NO: 506 - DNA, 77 bp, Homo sapiens
actgatttgtgattgaaagctgcctttctatttacttgagtcttgtacatacatacttttttatgagctatgaaata

SEQ ID NO: 507 - DNA, 122 bp, Homo sapiens
cccagatgtcattcgtgctgaaagaaccagaacaactctctgctccctgccaagcatgaagcggttgtgaccccaggaaaccacagtgactttgactctggttcagctgacatgctcgagtc

SEQ ID NO: 508 - DNA, 34 bp, Homo sapiens
gctccagtccccagctcactcagccacacacacc

SEQ ID NO: 509 - DNA, 112 bp, Homo sapiens
aggagaccaccgcgctcgtgtgtgacaatggctctggcctgtgcaaggcaggcttcgcaggagatgatgccccccgggctgtcttcccctccattgtgggccgccctcgcca

SEQ ID NO: 510 - DNA, 52 bp, Homo sapiens
ggctcagagcaagcgagggatcctaactctcaaataccccattgaacacggc

SEQ ID NO: 511 - DNA, 84 bp, Homo sapiens
ctgcgtgtagcacctgaagagcaccccaccctgctcacagaggctcccctaaatcccaaggccaacagggaaaagatgacccag

SEQ ID NO: 512 - DNA, 60 bp, Homo sapiens
cctgccatgtacgtcgccattcaagctgtgctctccctctatgcctctggccgcacgaca

SEQ ID NO: 513 - DNA, 147 bp, Homo sapiens
ggattcaggtgatggcgtcacccacaatgtccccatctatgaaggctatgccctgccccatgccatcatgcgcctggacttggctggccgtgacctcacggactacctcatgaagatcctcacagagagaggctattcctttgtgac

SEQ ID NO: 514 - DNA, 26 bp, Homo sapiens
agagagaaattgtgcgagacatcaag

SEQ ID NO: 515 - DNA, 43 bp, Homo sapiens
ggcaatgagcgcttccgctgccctgagaccctcttccagcctt

SEQ ID NO: 516 - DNA, 86 bp, Homo sapiens
gcatggagtccgctggaattcatgagacaacctacaattccatcatgaagtgtgacattgacatccgtaaggacttatatgccaac

SEQ ID NO: 517 - DNA, 33 bp, Homo sapiens
aaggagatcacagccctggcccccagcaccatg

SEQ ID NO: 518 - DNA, 128 bp, Homo sapiens
cccagagcggaagtactcagtctggatcgggggctctatcctggcctctctctccaccttccagcagatgtggatcagcaagcctgagtatgatgaggcagggccctccattgtccacaggaagtgct

SEQ ID NO: 519 - DNA, 46 bp, Homo sapiens
caaggatcccctcgagactactctgttaccagtcatgaaacattaa

SEQ ID NO: 520 - DNA, 171 bp, Homo sapiens
ctcttttttcctgggctatgtctcatacacagtgctaaggacttttcacacattacttttaatccatgcaatagtgctgtaaggtaggtgctatcattatacccatattacagatgaggaaattgaggctcagagaagtcaaggacttgcgaagatcacacagattccaga

SEQ ID NO: 521 - DNA, 29 bp, Homo sapiens
tgggagcaccaggatctcgggctcggaac

SEQ ID NO: 522 - DNA, 35 bp, Homo sapiens
ccattgagcaggagaagcggagtgaaatttcctaa

SEQ ID NO: 523 - DNA, 28 bp, Homo sapiens
aagagccacctgcaagatggacacgagc

SEQ ID NO: 524 - DNA, 38 bp, Homo sapiens
ccccccaatcggactgccaaattctccggtttgccccg

SEQ ID NO: 525 - DNA, 82 bp, Homo sapiens
caggccactgggctccgcggagccagcgagaggtctgcgcggagtctgagcggcgctcgtcccgtcccaaggccgacgccag

SEQ ID NO: 526 - DNA, 52 bp, Homo sapiens
tgcccagtggcttctcggtcttcaccaccttgcccgacttgctcttcatctt

SEQ ID NO: 527 - DNA, 82 bp, Homo sapiens
tgggtgatgttcgtgtctgtgttctgcttcgtggccaccaccaccttgatcatcctgtacataattggagcccacggtggag

SEQ ID NO: 528 - DNA, 97 bp, Homo sapiens
caccgctgccctcttttacctcagcgcctcagtcctggaggccctggccaccatcacgatgcaagacggcttcacctacaggcactaccatgaaaac

SEQ ID NO: 529 - DNA, 58 bp, Homo sapiens
gtgttctcctacatagccactctgctctacgtggtccatgcggtgttctctttaatca

SEQ ID NO: 530 - DNA, 208 bp, Homo sapiens
tgctgtgtttactctcccgtgtgccttcgcgtccgggttgggagcttgctgtgtctaacctccaactgctgtgctgtctgctagggtcacctcctgtttgtgaaaggggaccttcttgttcgggggtgggaagtggcgaccgtgacctgagaaggaaagaaagatcctctgctgacccctggagcagctctcgagaactacctgttgg

SEQ ID NO: 531 - DNA, 35 bp, Homo sapiens
gattgcacaagagatagccagtctttcaaaagagg

SEQ ID NO: 532 - DNA, 154 bp, Homo sapiens
gctcattcagcggtcgcgagctgcccgcgagggggagcggccggacggagagcgcgacccgtcccgggggtggggccgggcgcagcggcgagaggaggcgaaggtggctgcggtagcagcagcgcggcagcctcggacccagcccggagcgcag

SEQ ID NO: 533 - DNA, 158 bp, Homo sapiens
gctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggaca

SEQ ID NO: 534 - DNA, 100 bp, Homo sapiens
cgggcagaagcgcttccactgcagagagccaacagaacgggagggctgtacagctgcgacatcaccgcccgggggccatgcacgcggatcgagtttgata

SEQ ID NO: 535 - DNA, 63 bp, Homo sapiens
tgaccccacgtcagaaagcaaggaagatcagtggatgggggtcaccgtccagagccaaggtcc

SEQ ID NO: 536 - DNA, 115 bp, Homo sapiens
tgtgctcaccgatatgaaaaaaggcagcatgttaatacgaagcaggaatcccgagacatctttgggcggtgttatgtcctgagtcagaatctcaggattgaagacgatatggatg

SEQ ID NO: 537 - DNA, 103 bp, Homo sapiens
gaccagcgtttcctatacagatcctgatcagtttgtttataaaacacggcctccccgggagcagcctgacacattccctgatgtgatgatgaatagctaccta

SEQ ID NO: 538 - DNA, 117 bp, Homo sapiens
tctggtgctcccagagccaatcacagtggagccgtggttttgctgaagagagacatgaagtctgcacatctcctccctgagcacatattcgatggagaaggtctggcctcttcattt

SEQ ID NO: 539 - DNA, 137 bp, Homo sapiens
gttggaggtgcagtgtatgtctacatgaaccagcaaggcagatggaataatgtgaagccaattcgtcttaatggaaccaaagattctatgtttggcattgcagtaaaaaatattggagatattaatcaagatggcta

SEQ ID NO: 540 - DNA, 58 bp, Homo sapiens
atattgcagttggagctccgtatgatgacttgggaaaggtttttatctatcatggatc

SEQ ID NO: 541 - DNA, 99 bp, Homo sapiens
caccttattttggatattcaattgctggaaacatggaccttgatcgaaattcctaccctgatgttgctgttggttccctctcagattcagtaactattt

SEQ ID NO: 542 - DNA, 85 bp, Homo sapiens
tcccggcctgtgattaatattcagaaaaccatcacagtaactcctaacagaattgacctccgccagaaaacagcgtgtggggcgc

SEQ ID NO: 543 - DNA, 67 bp, Homo sapiens
agaaaatctgggctatcctcaagagttcagtttcgaaaccaaggttctgagcccaaatatactcaag

SEQ ID NO: 544 - DNA, 135 bp, Homo sapiens
tcagagataaactgcgtcccattcccataactgcctcagtggagatccaagagccaagctctcgtaggcgagtgaattcacttccagaagttcttccaattctgaattcagatgaacccaagacagctcatattg

SEQ ID NO: 545 - DNA, 82 bp, Homo sapiens
acttcttaaaagagggatgtggagacgacaatgtatgtaacagcaaccttaaactagaatataaattttgcacccgagaagg

SEQ ID NO: 546 - DNA, 89 bp, Homo sapiens
cccaaggaatcccacaaaagatggcgatgacgcccatgaggctaaactgattgcaacgtttccagacactttaacctattctgcatata

SEQ ID NO: 547 - DNA, 59 bp, Homo sapiens
gttgtgttgccaaccagaatggctcgcaagctgactgtgagctcggaaatccttttaaa

SEQ ID NO: 548 - DNA, 61 bp, Homo sapiens
ttggttttaagtacaactgaagtcacctttgacaccccagatctggatattaatctgaagt

SEQ ID NO: 549 - DNA, 88 bp, Homo sapiens
ttcccaggtgtattttggaggtacagttgttggcgagcaagctatgaaatctgaagatgaagtgggaagtttaatagagtatgaattc

SEQ ID NO: 550 - DNA, 100 bp, Homo sapiens
aaacctcttacaaacctcggcacagcaaccttgaacattcagtggccaaaagaaattagcaatgggaaatggttgctttatttggtgaaagtagaatcca

SEQ ID NO: 551 - DNA, 37 bp, Homo sapiens
taacttgtgagccacaaaaggagataaactccctgaa

SEQ ID NO: 552 - DNA, 120 bp, Homo sapiens
cttgctggttttacacttacttctgtgcctttggcaggagagaggcaaatattgttgattatgtgaatctggcactgtttgggaggatatgctcaagaggcttgtatggtaatgacaaag

SEQ ID NO: 553 - DNA, 30 bp, Homo sapiens
aacagatagatgataacagaaaattttctt

SEQ ID NO: 554 - DNA, 84 bp, Homo sapiens
tgtgtgaacatcagatgcccgctgcgggggctggacagcaaggcgtctcttattttgcgctcgaggttatggaacagcacattt

SEQ ID NO: 555 - DNA, 74 bp, Homo sapiens
ggacattctcatgcgagccttcattgatgtgactgctgctgccgaaaatatcaggctgccaaatgcaggcactc

SEQ ID NO: 556 - DNA, 94 bp, Homo sapiens
tttccctcaaagactgtagctcagtattcgggagtaccttggtggatcatcctagtggctattctcgctgggatcttgatgcttgctttattag

SEQ ID NO: 557 - DNA, 63 bp, Homo sapiens
tatgatgccacatatcacaaggctgagatccatgctcagccatctgataaagagaggcttact

SEQ ID NO: 558 - DNA, 83 bp, Homo sapiens
gtggattctttaaacgctctaggtacgatgacagtgttccccgataccatgctgtaaggatccggaaagaagagcgagagatc

SEQ ID NO: 559 - DNA, 31 bp, Homo sapiens
tcacaaagtggaacgaaaatgaaagctactc

SEQ ID NO: 560 - DNA, 233 bp, Homo sapiens
tgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttc

SEQ ID NO: 561 - DNA, 72 bp, Homo sapiens
ggtgaatgcctatggtggatccaaactgatccagtataagactactgaatctgctaccaaaacagttaatca

SEQ ID NO: 562 - DNA, 226 bp, Homo sapiens
agtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtt

SEQ ID NO: 563 - DNA, 111 bp, Homo sapiens
tgagttttatgacgggcccggtgctgaagggcagggaacaacttgatggtgctactttgaactgcttttcttttctcctttttgcacaaagagtctcatgtctgatattta

SEQ ID NO: 564 - DNA, 75 bp, Homo sapiens
atgagctttgtgcaaaaggggagctggctacttctcgctctgcttcatcccactattattttggcacaacaggaa

SEQ ID NO: 565 - DNA, 31 bp, Homo sapiens
ctgttgaaggaggatgttcccatcttggtca

SEQ ID NO: 566 - DNA, 92 bp, Homo sapiens
gttctctgcgatgacataatatgtgacgatcaagaattagactgccccaacccagaaattccatttggagaatgttgtgcagtttgcccaca

SEQ ID NO: 567 - DNA, 37 bp, Homo sapiens
cctactcgccctcctaatggtcaaggacctcaaggcc

SEQ ID NO: 568 - DNA, 25 bp, Homo sapiens
accccctggtgaacctgggcaagct

SEQ ID NO: 569 - DNA, 25 bp, Homo sapiens
ggacctcctggtgctataggtccat

SEQ ID NO: 570 - DNA, 26 bp, Homo sapiens
caaaggtccagctgggatacctggat

SEQ ID NO: 571 - DNA, 36 bp, Homo sapiens
ggtgaaaatggtcttccaggcgaaaatggagctcct

SEQ ID NO: 572 - DNA, 32 bp, Homo sapiens
ggtgagcgaggacggccaggacttcctggggc

SEQ ID NO: 573 - DNA, 37 bp, Homo sapiens
ctggaactgccggattccctggatcccctggtgctaa

SEQ ID NO: 574 - DNA, 31 bp, Homo sapiens
cctgcagggtctcctggttcaaatggtgccc

SEQ ID NO: 575 - DNA, 53 bp, Homo sapiens
gtgaggctggtattccaggtgttccaggagctaaaggcgaagatggcaaggat

SEQ ID NO: 576 - DNA, 51 bp, Homo sapiens
gtgcccctgggttccgaggacctgctggaccaaatggcatcccaggagaaa

SEQ ID NO: 577 - DNA, 25 bp, Homo sapiens
cctgctggagagcgtggtgctccag

SEQ ID NO: 578 - DNA, 25 bp, Homo sapiens
gaagtgatgggaaaccagggcctcc

SEQ ID NO: 579 - DNA, 85 bp, Homo sapiens
tcaaggagaaagtggtcgaccaggtcctcctgggccatctggtccccgaggtcagcctggtgtcatgggcttccccggtcctaaa

SEQ ID NO: 580 - DNA, 28 bp, Homo sapiens
tggtaagaatggagaacgaggtggccct

SEQ ID NO: 581 - DNA, 30 bp, Homo sapiens
gaaagaatggtgaaactggacctcagggac

SEQ ID NO: 582 - DNA, 50 bp, Homo sapiens
cctggtggtgacaaaggagacacaggaccccctggtccacaaggattaca

SEQ ID NO: 583 - DNA, 32 bp, Homo sapiens
ggcttgcctggtacaggtggtcctccaggaga

SEQ ID NO: 584 - DNA, 30 bp, Homo sapiens
ggtccaaagggtgatgccggtgcacctgga

SEQ ID NO: 585 - DNA, 27 bp, Homo sapiens
gtgcccctggtgaacgtggacctcctg

SEQ ID NO: 586 - DNA, 27 bp, Homo sapiens
ggaggtcttggaagtcctggtccaaag

SEQ ID NO: 587 - DNA, 32 bp, Homo sapiens
aaccaggcggtccaggtgctgatggtgtccca

SEQ ID NO: 588 - DNA, 34 bp, Homo sapiens
ggtcctactggtcctattggtcctcctggcccag

SEQ ID NO: 589 - DNA, 47 bp, Homo sapiens
gtgagagaggtgaaactggccctccaggacctgctggtttccctggt

SEQ ID NO: 590 - DNA, 72 bp, Homo sapiens
gacagaatggtgaacctggtggtaaaggagaaagaggggctccgggtgagaaaggtgaaggaggccctcctg

SEQ ID NO: 591 - DNA, 44 bp, Homo sapiens
cctggtccccaaggtgtcaaaggtgaacgtggcagtcctggtgg

SEQ ID NO: 592 - DNA, 25 bp, Homo sapiens
gcttccctggtgctcgtggtcttcc

SEQ ID NO: 593 - DNA, 87 bp, Homo sapiens
ttctcatcatacacttcagaaagagcattcatgtatgtataggatgagaaacttacacattgctacttatttctctagtaagtctca

SEQ ID NO: 594 - DNA, 92 bp, Homo sapiens
tcccagcggttctccaggcaaggatgggcccccaggtcctgcgggtaacactggtgctcctggcagccctggagtgtctggaccaaaaggtg

SEQ ID NO: 595 - DNA, 45 bp, Homo sapiens
gcccacttgggattgctgggatcactggagcacggggtcttgcag

SEQ ID NO: 596 - DNA, 25 bp, Homo sapiens
atgccaggtcctaggggaagccctg

SEQ ID NO: 597 - DNA, 92 bp, Homo sapiens
tgggaaaccaggagctaacggtctcagtggagaacgtggtccccctggaccccagggtcttcctggtctggctggtacagctggtgaacctg

SEQ ID NO: 598 - DNA, 25 bp, Homo sapiens
gcccacctggtcctgtcggtccagc

SEQ ID NO: 599 - DNA, 36 bp, Homo sapiens
gccctgctggtgctcccggtcctgctggttcccgag

SEQ ID NO: 600 - DNA, 71 bp, Homo sapiens
gtgacaaaggtgaaacaggtgaacgtggagctgctggcatcaaaggacatcgaggattccctggtaatcca

SEQ ID NO: 601 - DNA, 30 bp, Homo sapiens
cagcagggtgcaatcggcagtccaggacct

SEQ ID NO: 602 - DNA, 39 bp, Homo sapiens
caggtcccattggaccaccagggcctcgaggtaacagag

SEQ ID NO: 603 - DNA, 492 bp, Homo sapiens
tgtccacattgctatcccactagagatctcagaattacaacattcataattatctgcgtttatgtagtgcattttacttctcaaacagcttccatggttactattttgttaatgatactatcattcctaatactttctattccatgcctttgggtaaatgaaataaaaacaattatcccaacaaattacactcccctctgtcatgtcaatattggaattgtagctcacaggtgtttgcttacatcagtcatccagaaggaagaatgatagagaaaacttgtgctctgacactactgattcttacatagtggaacaatatctttcttgataatgaattgtagttattataaatcggtgatcacgtgaccctaaaggcacccaaataaatctttagtaaaataattctgatgacacaatgaatgaattatttttaaggcattttcttggactagcaatgtattcttagagtggcgactgaatgtgcatacctca

SEQ ID NO: 604 - DNA, 55 bp, Homo sapiens
cacccagggcaaccaggccctcctggacctcctggtgcccctggtccttgctgtg

SEQ ID NO: 605 - DNA, 29 bp, Homo sapiens
gtggtgttggagccgctgccattgctggg

SEQ ID NO: 606 - DNA, 125 bp, Homo sapiens
caccgatgagattatgacttcactcaagtctgttaatggacaaatagaaagcctcattagtcctgatggttctcgtaaaaaccccgctagaaactgcagagacctgaaattctgccatcctgaac

SEQ ID NO: 607 - DNA, 25 bp, Homo sapiens
gagaatactgggttgaccctaacca

SEQ ID NO: 608 - DNA, 33 bp, Homo sapiens
ttggatgctatcaaggtattctgtaatatggaa

SEQ ID NO: 609 - DNA, 91 bp, Homo sapiens
tttgaatgttccacggaaacactggtggacagattctagtgctgagaagaaacacgtttggtttggagagtccatggatggtggttttcag

SEQ ID NO: 610 - DNA, 212 bp, Homo sapiens
aataagtcacctctatatcctttgtattcttcctatatgttcatcacaaagcaaagttactaggttggtacaaacataattgcagtttttgctactgaaagtgatggcatgcaataaaaatattttcacacataaaatactcgtacataaaatatataaacagcccatattacaatatgcatacacatactacatgaatccctcgcgtgcag

SEQ ID NO: 611 - DNA, 45 bp, Homo sapiens
ttacaactgaaatgtttgatctgttttatttgttccctattacag

SEQ ID NO: 612 - DNA, 110 bp, Homo sapiens
agatgtccttgatgtgcatctggcattccttcgacttctctccagccgagcttcccagaacatcacatatcactgcaaaaatagcattgcatacatggatcaggccagtg

SEQ ID NO: 613 - DNA, 51 bp, Homo sapiens
tgaattcaaggctgaaggaaatagcaaattcacctacacagttctggagga

SEQ ID NO: 614 - DNA, 87 bp, Homo sapiens
tttgaatatcgaacacgcaaggctgtgagactacctattgtagatattgcaccctatgacattggtggtcctgatcaagaatttggt

SEQ ID NO: 615 - DNA, 204 bp, Homo sapiens
ctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaa

SEQ ID NO: 616 - DNA, 373 bp, Homo sapiens
gagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgta

SEQ ID NO: 617 - DNA, 37 bp, Homo sapiens
gaaagattcattggcatgccacaggggattctcctcc

SEQ ID NO: 618 - DNA, 88 bp, Homo sapiens
aaattatggggctgcttttgtcacactagcatagagaatgtgttgaaatttaactttgtaagcttgtatgtggttgttgatctttttt

SEQ ID NO: 619 - DNA, 35 bp, Homo sapiens
atgagccaggcctactcgtccagccagcgcgtgtc

SEQ ID NO: 620 - DNA, 87 bp, Homo sapiens
tgagttcgcccgtgttcccgcgggcgggtttcggctctaagggctcctccagctcggtgacgtcccgcgtgtaccaggtgtcgcgca

SEQ ID NO: 621 - DNA, 28 bp, Homo sapiens
ggcctggggtcgctgcgggccagccggc

SEQ ID NO: 622 - DNA, 166 bp, Homo sapiens
tggacttctcactggccgacgcggtgaaccaggagtttctgaccacgcgcaccaacgagaaggtggagctgcaggagctcaatgaccgcttcgccaactacatcgagaaggtgcgcttcctggagcagcagaacgcggcgctcgccgccgaagtgaaccggctcaa

SEQ ID NO: 623 - DNA, 70 bp, Homo sapiens
tgctcactaaccagcgcgcgcgcgtcgacgtcgagcgcgacaacctgctcgacgacctgcagcggctcaa

SEQ ID NO: 624 - DNA, 77 bp, Homo sapiens
gctactctagctcgcattgacctggagcgcagaattgaatctctcaacgaggagatcgcgttccttaagaaagtgca

SEQ ID NO: 625 - DNA, 73 bp, Homo sapiens
cctcagggacatccgggctcagtatgagaccatcgcggctaagaacatttctgaagctgaggagtggtacaag

SEQ ID NO: 626 - DNA, 120 bp, Homo sapiens
gtgtcagacctgacccaggcagccaacaagaacaacgacgccctgcgccaggccaagcaggagatgatggaataccgacaccagatccagtcctacacctgcgagattgacgccctgaag

SEQ ID NO: 627 - DNA, 108 bp, Homo sapiens
cgggaattggaggaccgatttgccagtgaggccagtggctaccaggacaacattgcgcgcctggaggaggaaatccggcacctcaaggatgagatggcccgccatctg

SEQ ID NO: 628 - DNA, 34 bp, Homo sapiens
cccatccagacctactctgccctcaacttccgag

SEQ ID NO: 629 - DNA, 25 bp, Homo sapiens
ttggggtctgctagggctctgccca

SEQ ID NO: 630 - DNA, 45 bp, Homo sapiens
agcctggacttggtcaggctgagtgtgcgatggaccctgttacag

SEQ ID NO: 631 - DNA, 63 bp, Homo sapiens
aaggggttctgaggtccataccaagaagacggtgatgatcaagaccatcgagacacgggatgg

SEQ ID NO: 632 - DNA, 42 bp, Homo sapiens
gtcgtcagtgaggccacacagcagcagcatgaagtgctctaa

SEQ ID NO: 633 - DNA, 26 bp, Homo sapiens
ctgccaccagagaccgtcctcacccc

SEQ ID NO: 634 - DNA, 60 bp, Homo sapiens
tggtccccaacagcgacatagcccatccctgcctggtcacagggcatgccccggccacct

SEQ ID NO: 635 - DNA, 67 bp, Homo sapiens
caggtagccagggggactagcccctgtggagactggggggcttgaaattgtccccgtggtctcttac

SEQ ID NO: 636 - DNA, 31 bp, Homo sapiens
ctacaagagggaatccccgaaggtgctggag

SEQ ID NO: 637 - DNA, 60 bp, Homo sapiens
gaaagtgggtgagatgctggagaagagaggagaggagagaggcagagagcggtctcaggc

SEQ ID NO: 638 - DNA, 42 bp, Homo sapiens
cagcttagaatcccagctgctggctcgggctgcagttctctc

SEQ ID NO: 639 - DNA, 56 bp, Homo sapiens
atggctcgcacagggtggaccagccccattcccctatgtgtttctctgctgctgac

SEQ ID NO: 640 - DNA, 25 bp, Homo sapiens
tgggagtcactggttcaccatgcag

SEQ ID NO: 641 - DNA, 26 bp, Homo sapiens
tatttctgagttcatccaatggtttt

SEQ ID NO: 642 - DNA, 219 bp, Homo sapiens
gagtacggaaccacatcatgcacttggaggaacatttattttgccagtatttttccaaaaatgccctagaaatagcctctgaaattctccaaacacctgtcacagcatatgatctctacagccacacatcaatttggttgttgcgaacagactttgttttggactatcccaaacccgtgatgcccaatatgatcttcattggtggtatcaactgccatc

SEQ ID NO: 643 - DNA, 42 bp, Homo sapiens; identical to SEQ ID NO: 638

SEQ ID NO: 644 - DNA, 52 bp, Homo sapiens
atggctcgcgcagggtggaccagccccgttcctttatgtgtgtgtctactgc

SEQ ID NO: 645 - DNA, 52 bp, Homo sapiens; identical to SEQ ID NO: 644

SEQ ID NO: 646 - DNA, 25 bp, Homo sapiens
tgggagtcactggttcaccatgcag

SEQ ID NO: 647 - DNA, 36 bp, Homo sapiens
gtgagttggcaactggaaagatcactgaattgcaca

SEQ ID NO: 648 - DNA, 36 bp, Homo sapiens; identical to SEQ ID NO: 647

SEQ ID NO: 649 - DNA, 58 bp, Homo sapiens
ctctggaagatcagaaccgggaattcatggttttcgcccatgctcaatggaaagcaca

SEQ ID NO: 650 - DNA, 58 bp, Homo sapiens; identical to SEQ ID NO: 649

SEQ ID NO: 651 - DNA, 26 bp, Homo sapiens
ctctattaatgagttcatccagtggt

SEQ ID NO: 652 - DNA, 26 bp, Homo sapiens
ctctattaatgagttcatccagtggt

SEQ ID NO: 653 - DNA, 112 bp, Homo sapiens
tctggatccttttgatacctgtggcttaattgttgctaaatatttctccctcccctctgtggtcttcaccaggggaatattttgccaccatcttgaagaaggtgcacagtgc

SEQ ID NO: 654 - DNA, 112 bp, Homo sapiens; identical to SEQ ID NO: 653

SEQ ID NO: 655 - DNA, 70 bp, Homo sapiens
tcaatttggttgttgcgaacggactttgttttggactatcccaaacccgtgatgcccaacatgatcttca

SEQ ID NO: 656 - DNA, 70 bp, Homo sapiens; identical to SEQ ID NO: 655

SEQ ID NO: 657 - DNA, 84 bp, Homo sapiens
taaggaaccacatcttctacttagaggagcatttattttgcccatattttttcaaaaatgccttaaacatagcctctgaaattc

SEQ ID NO: 658 - DNA, 84 bp, Homo sapiens; identical to SEQ ID NO: 657

SEQ ID NO: 659 - DNA, 25 bp, Homo sapiens
catcaatttggttgctgcgaatgga

SEQ ID NO: 660 - DNA, 25 bp, Homo sapiens
catcaatttggttgctgcgaatgga

SEQ ID NO: 661 - DNA, 25 bp, Homo sapiens
gcttagattcccagctgcttgctct

SEQ ID NO: 662 - DNA, 25 bp, Homo sapiens
gcttagattcccagctgcttgctct

SEQ ID NO: 663 - DNA, 25 bp, Homo sapiens
gcttagattcccagctgcttgctct

SEQ ID NO: 664 - DNA, 72 bp, Homo sapiens
atggcttgcacagggtggaccagcccccttcctctatgtgtgtgtctgctgctgacctgtggctttgccgag

SEQ ID NO: 665 - DNA, 72 bp, Homo sapiens; identical to SEQ ID NO: 664

SEQ ID NO: 666 - DNA, 72 bp, Homo sapiens; identical to SEQ ID NO: 664

SEQ ID NO: 667 - DNA, 120 bp, Homo sapiens
tattcaacttcatataccctggaggatctggaccgggagttcaaggcttttgcccatgctcaatggaaagcacaagtacgaagtatatattctctattaatgggttcatacaatgacatt

SEQ ID NO: 668 - DNA, 120 bp, Homo sapiens; identical to SEQ ID NO: 667

SEQ ID NO: 669 - DNA, 120 bp, Homo sapiens; identical to SEQ ID NO: 667

SEQ ID NO: 670 - DNA, 36 bp, Homo sapiens
tttcaaggagagagtacggaaccacatcatgcactt

SEQ ID NO: 671 - DNA, 36 bp, Homo sapiens
ctccaaacacctgttacggagtatgatctctacagc

SEQ ID NO: 672 - DNA, 36 bp, Homo sapiens; identical to SEQ ID NO: 671

SEQ ID NO: 673 - DNA, 36 bp, Homo sapiens; identical to SEQ ID NO: 671

SEQ ID NO: 674 - DNA, 56 bp, Homo sapiens
atggctcgtgcagggtggactggcctccttcccctatatgtgtgtctactgctgac

SEQ ID NO: 675 - DNA, 56 bp, Homo sapiens; identical to SEQ ID NO: 674

SEQ ID NO: 676 - DNA, 56 bp, Homo sapiens; identical to SEQ ID NO: 674

SEQ ID NO: 677 - DNA, 61 bp, Homo sapiens
tgcagtcggtggtggagaaactcatcctcagggggcatgaggtggtcgtagtcatgccaga

SEQ ID NO: 678 - DNA, 61 bp, Homo sapiens; identical to SEQ ID NO: 677

SEQ ID NO: 679 - DNA, 61 bp, Homo sapiens; identical to SEQ ID NO: 677

SEQ ID NO: 680 - DNA, 70 bp, Homo sapiens
agttcatggtttttgccgatgctcgctggacggcaccattgcgaagtgcattttctctattaacaagttc

SEQ ID NO: 681 - DNA, 70 bp, Homo sapiens; identical to SEQ ID NO: 680

SEQ ID NO: 682 - DNA, 70 bp, Homo sapiens; identical to SEQ ID NO: 680

SEQ ID NO: 683 - DNA, 442 bp, Homo sapiens
gggtctccagcggagctactctttagggatcgtcattatgacgaacagacatgccagattcctctggctagtgtccagtgcagacatacacacacacacacatacacacacacacacacacacacaccattcttagtacagtcaaagctcacaggagaaagaaaaatgttttctaataccttcttaatttgcaagaaggtgttaggaattcaagggatggtatgcatagtgatgttagtttcatttcttcagctccttcctccaactcatgttctgtagggacttctgggactaagaacaggacccacatatgagcaacaggattttcagagcaaggctgtggttggaagggctcagaccaacgtccacagcagagtggaggtctagtataaagaatgtgaagtttgtagcatctcttgatcccgctattcctacatgcttg

SEQ ID NO: 684 - DNA, 442 bp, Homo sapiens; identical to SEQ ID NO: 683

SEQ ID NO: 685 - DNA, 442 bp, Homo sapiens; identical to SEQ ID NO: 683

SEQ ID NO: 686 - DNA, 108 bp, Homo sapiens
gcctaatgtctgcctgctcaagaaggtggacctgagctctgttccctttgcaaccttcctggagtcttattgctatctagatgaactcaaagcaagatgctgccgccc

SEQ ID NO: 687 - DNA, 108 bp, Homo sapiens; identical to SEQ ID NO: 686

SEQ ID NO: 688 - DNA, 108 bp, Homo sapiens; identical to SEQ ID NO: 686

SEQ ID NO: 689 - DNA, 452 bp, Homo sapiens
gctgagtcttcgcatgccttgaacaatgaatttgcatcctggttatgttccccatgggggccagccctgtccttggagtggcccctctaatcatgttgctcaggcttcttctcccttcctgggccccagaacacctccggtgccaaacttgtgggtgggaacaggaactcgcgtgccagccaggtgtgcatgactagctctgggcaagtctgttctagtaattcaaggtaccacctctcactgggacagcctagtttctacacaggtcttgctctgggaccgccctcagcagtgtggttagcaggcagggccagtgtgaccctccctttctgggcctcagttgagaaacctgaagctcaggagaggagtcactcccctggcagatgggtggctgggccagaagcagataccaggctttctgactcctgctctaggattctcaccacgtactg

SEQ ID NO: 690 - DNA, 452 bp, Homo sapiens; identical to SEQ ID NO: 689

SEQ ID NO: 691 - DNA, 452 bp, Homo sapiens; identical to SEQ ID NO: 689

SEQ ID NO: 692 - DNA, 292 bp, Homo sapiens
tctctaaggatgagggctagttgccagggaacaaaacccttgcgattagagggaagaaaggagagagagattgaagattgatttgatcaccgatgggcaacaatctaatcaatcatgcctactatgtatggaagcctacataaaaactcagaagggcagggttcagagagctttcaggttgctgaaggtgtggagggtggggcacccagagatggcagatggggctccatggccatacccccatatcttgttctttgtactttttcctctggctattcatccgtattgtttg

SEQ ID NO: 693 - DNA, 292 bp, Homo sapiens; identical to SEQ ID NO: 692

SEQ ID NO: 694 - DNA, 292 bp, Homo sapiens; identical to SEQ ID NO: 692

SEQ ID NO: 695 - DNA, 73 bp, Homo sapiens
tgaaaagcagtggttagtttagggaaaatacctaggagccctgtgatttggagagtgaaaactctttattacc

SEQ ID NO: 696 - DNA, 73 bp, Homo sapiens; identical to SEQ ID NO: 695

SEQ ID NO: 697 - DNA, 73 bp, Homo sapiens; identical to SEQ ID NO: 695

SEQ ID NO: 698 - DNA, 27 bp, Homo sapiens
atggcctgcctccttcgctcatttcag

SEQ ID NO: 699 - DNA, 27 bp, Homo sapiens
atggcctgcctccttcgctcatttcag

SEQ ID NO: 700 - DNA, 27 bp, Homo sapiens
atggcctgcctccttcgctcatttcag

SEQ ID NO: 701 - DNA, 35 bp, Homo sapiens
agaatttctgcaggggttttcttcttagcactttg

SEQ ID NO: 702 - DNA, 35 bp, Homo sapiens; identical to SEQ ID NO: 701

SEQ ID NO: 703 - DNA, 35 bp, Homo sapiens; identical to SEQ ID NO: 701

SEQ ID NO: 704 - DNA, 621 bp, Homo sapiens
tccctcaggacggaagccactggcttagtatgaaggatatagttgaggttctcagtgaccggggtcatgagattgtagtggtggtgcctgaagttaatttgcttttgaaagaatccaaatactacacaagaaaaatctatccagtgccgtatgaccaagaagagctgaagaaccgttaccaatcatttggaaacaatcactttgctgagcgatcattcctaactgctcctcagacagagtacaggaataacatgattgttattggcctgtacttcatcaactgccagagcctcctgcaggacagggacaccctgaacttctttaaggagagcaagtttgatgctcttttcacagacccagccttaccctgtggggtgatcctggctgagtatttgggcctaccatctgtgtacctcttcaggggttttccgtgttccctggagcatacattcagcagaagcccagaccctgtgtcctacattcccaggtgctacacaaagttttcagaccacatgactttttcccaacgagtggccaacttccttgttaatttgttggagccctatctattttattgtctgttttcaaagtatgaagaactcgcatcagctgtcctcaaga

SEQ ID NO: 705 - DNA, 621 bp, Homo sapiens; identical to SEQ ID NO: 704

SEQ ID NO: 706 - DNA, 621 bp, Homo sapiens; identical to SEQ ID NO: 704

SEQ ID NO: 707 - DNA, 37 bp, Homo sapiens
gtcttcattggaggtatcaactgtaagaagaggaaag

SEQ ID NO: 708 - DNA, 37 bp, Homo sapiens; identical to SEQ ID NO: 707

SEQ ID NO: 709 - DNA, 37 bp, Homo sapiens; identical to SEQ ID NO: 707

SEQ ID NO: 710 - DNA, 27 bp, Homo sapiens
acaggactccaggttcccctgccgcag

SEQ ID NO: 711 - DNA, 27 bp, Homo sapiens
acaggactccaggttcccctgccgcag

SEQ ID NO: 712 - DNA, 27 bp, Homo sapiens
acaggactccaggttcccctgccgcag

SEQ ID NO: 713 - DNA, 27 bp, Homo sapiens
acaggactccaggttcccctgccgcag

SEQ ID NO: 714 - DNA, 25 bp, Homo sapiens
aggtgctggtggtgcccactgatgg

SEQ ID NO: 715 - DNA, 25 bp, Homo sapiens
aggtgctggtggtgcccactgatgg

SEQ ID NO: 716 - DNA, 25 bp, Homo sapiens
aggtgctggtggtgcccactgatgg

SEQ ID NO: 717 - DNA, 25 bp, Homo sapiens
aggtgctggtggtgcccactgatgg

SEQ ID NO: 718 - DNA, 26 bp, Homo sapiens
acctccatgcgagaggccaccaggtg

SEQ ID NO: 719 - DNA, 26 bp, Homo sapiens
acctccatgcgagaggccaccaggtg

SEQ ID NO: 720 - DNA, 26 bp, Homo sapiens
acctccatgcgagaggccaccaggtg

SEQ ID NO: 721 - DNA, 26 bp, Homo sapiens
acctccatgcgagaggccaccaggtg

SEQ ID NO: 722 - DNA, 113 bp, Homo sapiens
gctgggtcacactcaatcgttctttgaaacagaacatcttctgatgaaattttctagaagaatggcaattatgaacaatatgtctttgatcatacataggtcttgtgtggagc

SEQ ID NO: 723 - DNA, 113 bp, Homo sapiens; identical to SEQ ID NO: 722

SEQ ID NO: 724 - DNA, 113 bp, Homo sapiens; identical to SEQ ID NO: 722

SEQ ID NO: 725 - DNA, 113 bp, Homo sapiens; identical to SEQ ID NO: 722

SEQ ID NO: 726 - DNA, 163 bp, Homo sapiens
gtgctggctaagtacctgtcgattcctgctgtgtttttcttgaggaacattccatgtgatttagactttaagggcacacagtgtccaaacccttcctcctatattcctagattactaacgaccaattcagaccacatgacattcctgcaaagggtcaagaaca

SEQ ID NO: 727 - DNA, 163 bp, Homo sapiens; identical to SEQ ID NO: 726

SEQ ID NO: 728 - DNA, 163 bp, Homo sapiens; identical to SEQ ID NO: 726

SEQ ID NO: 729 - DNA, 163 bp, Homo sapiens; identical to SEQ ID NO: 726

SEQ ID NO: 730 - DNA, 76 bp, Homo sapiens
tggatgaatggatacttcagtctctatgcagacttgcagaagactggagcctttggcattcagaagaggaattcag

SEQ ID NO: 731 - DNA, 76 bp, Homo sapiens; identical to SEQ ID NO: 730

SEQ ID NO: 732 - DNA, 76 bp, Homo sapiens; identical to SEQ ID NO: 730

SEQ ID NO: 733 - DNA, 76 bp, Homo sapiens; identical to SEQ ID NO: 730

SEQ ID NO: 734 - DNA, 31 bp, Homo sapiens
atggccagaggactccaggttcccctgccgc

SEQ ID NO: 735 - DNA, 31 bp, Homo sapiens; identical to SEQ ID NO: 734

SEQ ID NO: 736 - DNA, 31 bp, Homo sapiens; identical to SEQ ID NO: 734

SEQ ID NO: 737 - DNA, 31 bp, Homo sapiens; identical to SEQ ID NO: 734

SEQ ID NO: 738 - DNA, 31 bp, Homo sapiens; identical to SEQ ID NO: 734

SEQ ID NO: 739 - DNA, 26 bp, Homo sapiens
gactgctgctcctcctcagtgtccag

SEQ ID NO: 740 - DNA, 26 bp, Homo sapiens
gactgctgctcctcctcagtgtccag

SEQ ID NO: 741 - DNA, 26 bp, Homo sapiens
gactgctgctcctcctcagtgtccag

SEQ ID NO: 742 - DNA, 26 bp, Homo sapiens
gactgctgctcctcctcagtgtccag

SEQ ID NO: 743 - DNA, 26 bp, Homo sapiens
gactgctgctcctcctcagtgtccag

SEQ ID NO: 744 - DNA, 114 bp, Homo sapiens
gagagtggaaaggtgttggtggtgcccactgatggcagcccctggctcagcatgcgggaggccttgcgggagctccatgccagaggccaccaggcggtggtcctcaccccagag

SEQ ID NO: 745 - DNA, 114 bp, Homo sapiens; identical to SEQ ID NO: 744

SEQ ID NO: 746 - DNA, 114 bp, Homo sapiens; identical to SEQ ID NO: 744

SEQ ID NO: 747 - DNA, 114 bp, Homo sapiens; identical to SEQ ID NO: 744

SEQ ID NO: 748 - DNA, 114 bp, Homo sapiens; identical to SEQ ID NO: 744

SEQ ID NO: 749 - DNA, 144 bp, Homo sapiens
gcctatgctgttccatggacccagaaggaatttgatcgcgttacgctgggctacactcaagggttctttgaaacagaacatcttctgaagagatattctagaagtatggcaattatgaacaatgtatctttggcccttcatagg

SEQ ID NO: 750 - DNA, 144 bp, Homo sapiens; identical to SEQ ID NO: 749

SEQ ID NO: 751 - DNA, 144 bp, Homo sapiens; identical to SEQ ID NO: 749

SEQ ID NO: 752 - DNA, 144 bp, Homo sapiens; identical to SEQ ID NO: 749

SEQ ID NO: 753 - DNA, 144 bp, Homo sapiens; identical to SEQ ID NO: 749

SEQ ID NO: 754 - DNA, 69 bp, Homo sapiens
ttggtggtgcccattgatggcagccactggctcagcatgcgggaggtcttgcgggagctccatgccaga

SEQ ID NO: 755 - DNA, 69 bp, Homo sapiens; identical to SEQ ID NO: 754

SEQ ID NO: 756 - DNA, 69 bp, Homo sapiens; identical to SEQ ID NO: 754

SEQ ID NO: 757 - DNA, 69 bp, Homo sapiens; identical to SEQ ID NO: 754

SEQ ID NO: 758 - DNA, 69 bp, Homo sapiens; identical to SEQ ID NO: 754

SEQ ID NO: 759 - DNA, 69 bp, Homo sapiens; identical to SEQ ID NO: 754

SEQ ID NO: 760 - DNA, 331 bp, Homo sapiens
ctatcataggtcttgtgtggagctactacataatgaggccctgatcaggcacctgaatgctacttcctttgatgtggttttaacagaccccgttaacctctgcgcggcagtgctggctaagtacctgtcgattcctactgtgttttttttgaggaacattccatgtgatttagactttaagggcacacagtgtccaaacccttcctcctatattcctagattactaacaaccaattcagaccacatgacattcatgcaaagggtcaagaacatgctctaccctctggccctgtcctacatttgccatgctttttctgctccttatgcaagc

SEQ ID NO: 761 - DNA, 331 bp, Homo sapiens; identical to SEQ ID NO: 760

SEQ ID NO: 762 - DNA, 331 bp, Homo sapiens; identical to SEQ ID NO: 760

SEQ ID NO: 763 - DNA, 331 bp, Homo sapiens; identical to SEQ ID NO: 760

SEQ ID NO: 764 - DNA, 331 bp, Homo sapiens; identical to SEQ ID NO: 760

SEQ ID NO: 765 - DNA, 331 bp, Homo sapiens; identical to SEQ ID NO: 760

SEQ ID NO: 766 - DNA, 25 bp, Homo sapiens
ttccgaggggactttgtgatggact

SEQ ID NO: 767 - DNA, 25 bp, Homo sapiens
ttccgaggggactttgtgatggact

SEQ ID NO: 768 - DNA, 25 bp, Homo sapiens
ttccgaggggactttgtgatggact

SEQ ID NO: 769 - DNA, 25 bp, Homo sapiens
ttccgaggggactttgtgatggact

SEQ ID NO: 770 - DNA, 25 bp, Homo sapiens
ttccgaggggactttgtgatggact

SEQ ID NO: 771 - DNA, 25 bp, Homo sapiens
gcccaacatggtcttcattgggggc

SEQ ID NO: 772 - DNA, 25 bp, Homo sapiens
gcccaacatggtcttcattgggggc

SEQ ID NO: 773 - DNA, 25 bp, Homo sapiens
gcccaacatggtcttcattgggggc

SEQ ID NO: 774 - DNA, 25 bp, Homo sapiens
gcccaacatggtcttcattgggggc

SEQ ID NO: 775 - DNA, 35 bp, Homo sapiens
aggaccccaggttcccctgctgtggctggccacag

SEQ ID NO: 776 - DNA, 35 bp, Homo sapiens; identical to SEQ ID NO: 775

SEQ ID NO: 777 - DNA, 35 bp, Homo sapiens; identical to SEQ ID NO: 775

SEQ ID NO: 778 - DNA, 35 bp, Homo sapiens; identical to SEQ ID NO: 775

SEQ ID NO: 779 - DNA, 35 bp, Homo sapiens; identical to SEQ ID NO: 775

SEQ ID NO: 780 - DNA, 35 bp, Homo sapiens; identical to SEQ ID NO: 775

SEQ ID NO: 781 - DNA, 31 bp, Homo sapiens
gagtgctactccttctcagtgcccagccctg

SEQ ID NO: 782 - DNA, 31 bp, Homo sapiens; identical to SEQ ID NO: 781

SEQ ID NO: 783 - DNA, 31 bp, Homo sapiens; identical to SEQ ID NO: 781

SEQ ID NO: 784 - DNA, 31 bp, Homo sapiens; identical to SEQ ID NO: 781

SEQ ID NO: 785 - DNA, 31 bp, Homo sapiens; identical to SEQ ID NO: 781

SEQ ID NO: 786 - DNA, 31 bp, Homo sapiens; identical to SEQ ID NO: 781

SEQ ID NO: 787 - DNA, 33 bp, Homo sapiens
agaggccaccaggcggtggtcctcaccccagag

SEQ ID NO: 788 - DNA, 33 bp, Homo sapiens; identical to SEQ ID NO: 787

SEQ ID NO: 789 - DNA, 33 bp, Homo sapiens; identical to SEQ ID NO: 787

SEQ ID NO: 790 - DNA, 33 bp, Homo sapiens; identical to SEQ ID NO: 787

SEQ ID NO: 791 - DNA, 33 bp, Homo sapiens; identical to SEQ ID NO: 787

SEQ ID NO: 792 - DNA, 208 bp, Homo sapiens
ccttgtgctgggccacactcaactgtactttgaaacagaacattttctgaagacattttctaaaagtatggcaattttgaaaaattcatctttggtctttcataggtcttgtgtggagctactgcataatgaggccctgatcaggcacctgaatgctacttccttcgatgtggttttaatagacccaatttacctctgtggggcagtg

SEQ ID NO: 793 - DNA, 208 bp, Homo sapiens; identical to SEQ ID NO: 792

SEQ ID NO: 794 - DNA, 208 bp, Homo sapiens; identical to SEQ ID NO: 792

SEQ ID NO: 795 - DNA, 208 bp, Homo sapiens; identical to SEQ ID NO: 792

SEQ ID NO: 796 - DNA, 208 bp, Homo sapiens; identical to SEQ ID NO: 792

SEQ ID NO: 797 - DNA, 208 bp, Homo sapiens; identical to SEQ ID NO: 792

SEQ ID NO: 798 - DNA, 65 bp, Homo sapiens
tccgaggggactttgtgatggattaccccaggccgatcatgcccaacatggtcttcattgggggc

SEQ ID NO: 799 - DNA, 65 bp, Homo sapiens; identical to SEQ ID NO: 798

SEQ ID NO: 800 - DNA, 65 bp, Homo sapiens; identical to SEQ ID NO: 798

SEQ ID NO: 801 - DNA, 65 bp, Homo sapiens; identical to SEQ ID NO: 798

SEQ ID NO: 802 - DNA, 28 bp, Homo sapiens
tcctctgaccccccaaaatattctccag

SEQ ID NO: 803 - DNA, 28 bp, Homo sapiens
tcctctgaccccccaaaatattctccag

SEQ ID NO: 804 - DNA, 28 bp, Homo sapiens
tcctctgaccccccaaaatattctccag

SEQ ID NO: 805 - DNA, 28 bp, Homo sapiens
tcctctgaccccccaaaatattctccag

SEQ ID NO: 806 - DNA, 28 bp, Homo sapiens
tcctctgaccccccaaaatattctccag

SEQ ID NO: 807 - DNA, 28 bp, Homo sapiens
tcctctgaccccccaaaatattctccag

SEQ ID NO: 808 - DNA, 321 bp, Homo sapiens
cggccgccaaagaactccctgaagacctcggcggggtcacggaagctgaagacctactcgaaggggtccttgaagggcctgccgcctgcgcagccgccctccgccctcgcctcgccatagcggtcatagatatcgcgtttctacgcgtccgacaacacctcgtaggcctcagccacctgcttgaatcttctcaccgcttcctccctgtcctcggggtttttgtcggggtgccacttgagcgccagcttgcggtacgccttcttgataccctcggacgaggcctaccggggtactcccagcacctcgtagtagtccactatg

SEQ ID NO: 809 - DNA, 321 bp, Homo sapiens; identical to SEQ ID NO: 808

SEQ ID NO: 810 - DNA, 321 bp, Homo sapiens; identical to SEQ ID NO: 808

SEQ ID NO: 811 - DNA, 321 bp, Homo sapiens; identical to SEQ ID NO: 808

SEQ ID NO: 812 - DNA, 321 bp, Homo sapiens; identical to SEQ ID NO: 808

SEQ ID NO: 813 - DNA, 321 bp, Homo sapiens; identical to SEQ ID NO: 808

SEQ ID NO: 814 - DNA, 59 bp, Homo sapiens
gtctgaccggggctgaagacatcctgttgtttaggactgcggttctccaacgttccagc

SEQ ID NO: 815 - DNA, 59 bp, Homo sapiens; identical to SEQ ID NO: 814

SEQ ID NO: 816 - DNA, 59 bp, Homo sapiens; identical to SEQ ID NO: 814

SEQ ID NO: 817 - DNA, 59 bp, Homo sapiens; identical to SEQ ID NO: 814

SEQ ID NO: 818 - DNA, 59 bp, Homo sapiens; identical to SEQ ID NO: 814

SEQ ID NO: 819 - DNA, 59 bp, Homo sapiens; identical to SEQ ID NO: 814

SEQ ID NO: 820 - DNA, 97 bp, Homo sapiens
agtcccagggcggacgcccacttgtcctgggcctgctgctgtgtgtgctgggcccagtggtgtcccatgctgggaagatactgttgatcccagtgga

SEQ ID NO: 821 - DNA, 97 bp, Homo sapiens; identical to SEQ ID NO: 820

SEQ ID NO: 822 - DNA, 97 bp, Homo sapiens; identical to SEQ ID NO: 820

SEQ ID NO: 823 - DNA, 97 bp, Homo sapiens; identical to SEQ ID NO: 820

SEQ ID NO: 824 - DNA, 97 bp, Homo sapiens; identical to SEQ ID NO: 820

SEQ ID NO: 825 - DNA, 97 bp, Homo sapiens; identical to SEQ ID NO: 820

SEQ ID NO: 826 - DNA, 97 bp, Homo sapiens; identical to SEQ ID NO: 820

SEQ ID NO: 827 - DNA, 561 bp, Homo sapiens
tgtcctagcacctgacgcctcgttgtacatcagagacggagcattttacaccttgaagacgtaccctgtgccattccaaagggaggatgtgaaagagtcttttgttagtctcgggcataatgtttttgagaatgattctttcctgcagcgtgtgatcaaaacatacaagaaaataaaaaaggactctgctatgcttttgtctggctgttcccacttactgcacaacaaggagctcatggcctccctggcagaaagcagctttgatgtcatgctgacggaccctttccttccttgcagccccatcgtggcccagtacctgtctctgcccactgtattcttcttgcatgcactgccatgcagcctggaatttgaggctacccagtgccccaacccattctcctacgtgcccaggcctctctcctctcattcagatcacatgaccttcctgcagcgggtgaagaacatgctcattgccttttcacagaactttctgtgcgacgtggtttattccccgtatgcaacccttgcctcagaattccttcagagagaggtgactgtcca

SEQ ID NO: 828 - DNA, 561 bp, Homo sapiens; identical to SEQ ID NO: 827

SEQ ID NO: 829 - DNA, 561 bp, Homo sapiens; identical to SEQ ID NO: 827

SEQ ID NO: 830 - DNA, 561 bp, Homo sapiens; identical to SEQ ID NO: 827

SEQ ID NO: 831 - DNA, 561 bp, Homo sapiens; identical to SEQ ID NO: 827

SEQ ID NO: 832 - DNA, 561 bp, Homo sapiens; identical to SEQ ID NO: 827

SEQ ID NO: 833 - DNA, 561 bp, Homo sapiens; identical to SEQ ID NO: 827

SEQ ID NO: 834 - DNA, 121 bp, Homo sapiens
ttgaagcctacattaatgcttctggagaacatggaattgtggttttctctttgggatcaatggtctcagaaattccagagaagaaagctatggcaattgctgatgctttgggcaaaatccc

SEQ ID NO: 835 - DNA, 121 bp, Homo sapiens; identical to SEQ ID NO: 834

SEQ ID NO: 836 - DNA, 121 bp, Homo sapiens; identical to SEQ ID NO: 834

SEQ ID NO: 837 - DNA, 121 bp, Homo sapiens; identical to SEQ ID NO: 834

SEQ ID NO: 838 - DNA, 121 bp, Homo sapiens; identical to SEQ ID NO: 834

SEQ ID NO: 839 - DNA, 121 bp, Homo sapiens; identical to SEQ ID NO: 834

SEQ ID NO: 840 - DNA, 121 bp, Homo sapiens; identical to SEQ ID NO: 834

SEQ ID NO: 841 - DNA, 87 bp, Homo sapiens
gtcctgtggcggtacactggaacccgaccatcgaatcttgcgaacaacacgatacttgttaagtggctaccccaaaacgatctgctt

SEQ ID NO: 842 - DNA, 87 bp, Homo sapiens; identical to SEQ ID NO: 841

SEQ ID NO: 843 - DNA, 87 bp, Homo sapiens; identical to SEQ ID NO: 841

SEQ ID NO: 844 - DNA, 87 bp, Homo sapiens; identical to SEQ ID NO: 841

SEQ ID NO: 845 - DNA, 87 bp, Homo sapiens; identical to SEQ ID NO: 841

SEQ ID NO: 846 - DNA, 87 bp, Homo sapiens; identical to SEQ ID NO: 841

SEQ ID NO: 847 - DNA, 87 bp, Homo sapiens; identical to SEQ ID NO: 841

SEQ ID NO: 848 - DNA, 166 bp, Homo sapiens
gtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctgga

SEQ ID NO: 849 - DNA, 166 bp, Homo sapiens; identical to SEQ ID NO: 848

SEQ ID NO: 850 - DNA, 166 bp, Homo sapiens; identical to SEQ ID NO: 848

SEQ ID NO: 851 - DNA, 166 bp, Homo sapiens; identical to SEQ ID NO: 848

SEQ ID NO: 852 - DNA, 166 bp, Homo sapiens; identical to SEQ ID NO: 848

SEQ ID NO: 853 - DNA, 166 bp, Homo sapiens; identical to SEQ ID NO: 848

SEQ ID NO: 854 - DNA, 166 bp, Homo sapiens; identical to SEQ ID NO: 848

SEQ ID NO: 855 - DNA, 30 bp, Homo sapiens
aagaagcagcagtcaggaagacagatgtga

SEQ ID NO: 856 - DNA, 30 bp, Homo sapiens; identical to SEQ ID NO: 855

SEQ ID NO: 857 - DNA, 30 bp, Homo sapiens; identical to SEQ ID NO: 855

SEQ ID NO: 858 - DNA, 30 bp, Homo sapiens; identical to SEQ ID NO: 855

SEQ ID NO: 859 - DNA, 30 bp, Homo sapiens; identical to SEQ ID NO: 855

SEQ ID NO: 860 - DNA, 30 bp, Homo sapiens; identical to SEQ ID NO: 855

SEQ ID NO: 861 - DNA, 30 bp, Homo sapiens; identical to SEQ ID NO: 855

SEQ ID NO: 862 - DNA, 405 bp, Homo sapiens
ttcagatgagaggagacggaacacggggacacaccagcttgagcaagggacaacaggggaggactgatgactgacttcccacctttgaggtgctaatgtgtgtgtggtggcactggataaaagatcaatgttggctaggcaccatggcacacgcctgtagtcccagccactctggaggctaaggcgggaggattgcttgagcccagaagttggaggctgctatgagccgtgatcatgccactgcactccagcaacctgggcaacagagtgagaccctgtctcaaaaaaaaaaaaaaaaatgaaaagtccacataacctgagcatcatgtgcccagagcgttgggtggtgtggtcccattccttccttccagcggcttcttctggccacctcaatgtcaggatgtc

SEQ ID NO: 863 - DNA, 405 bp, Homo sapiens; identical to SEQ ID NO: 862

SEQ ID NO: 864 - DNA, 405 bp, Homo sapiens; identical to SEQ ID NO: 862

SEQ ID NO: 865 - DNA, 405 bp, Homo sapiens; identical to SEQ ID NO: 862

SEQ ID NO: 866 - DNA, 405 bp, Homo sapiens; identical to SEQ ID NO: 862

SEQ ID NO: 867 - DNA, 405 bp, Homo sapiens; identical to SEQ ID NO: 862

SEQ ID NO: 868 - DNA, 405 bp, Homo sapiens; identical to SEQ ID NO: 862

SEQ ID NO: 869 - DNA, 226 bp, Homo sapiens
gaagctccttcttgaggctcacattatggatataattttgattctttcttcagtggtatagataactacttgtaacctaagaacaacttggtgaaagtcctctaatacattattttttaaaaaaacacaaatcaatgagctcaacttattaactaactttcatctattcatttttgagccatccctgtctgattgtgaatctccatgattccaacactctgagctg

SEQ ID NO: 870 - DNA, 226 bp, Homo sapiens; identical to SEQ ID NO: 869

SEQ ID NO: 871 - DNA, 226 bp, Homo sapiens; identical to SEQ ID NO: 869

SEQ ID NO: 872 - DNA, 226 bp, Homo sapiens; identical to SEQ ID NO: 869

SEQ ID NO: 873 - DNA, 226 bp, Homo sapiens; identical to SEQ ID NO: 869

SEQ ID NO: 874 - DNA, 226 bp, Homo sapiens; identical to SEQ ID NO: 869

SEQ ID NO: 875 - DNA, 226 bp, Homo sapiens; identical to SEQ ID NO: 869

SEQ ID NO: 876 - DNA, 141 bp, Homo sapiens
gtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatc

SEQ ID NO: 877 - DNA, 141 bp, Homo sapiens; identical to SEQ ID NO: 876

SEQ ID NO: 878 - DNA, 141 bp, Homo sapiens; identical to SEQ ID NO: 876

SEQ ID NO: 879 - DNA, 141 bp, Homo sapiens; identical to SEQ ID NO: 876

SEQ ID NO: 880 - DNA, 141 bp, Homo sapiens; identical to SEQ ID NO: 876

SEQ ID NO: 881 - DNA, 141 bp, Homo sapiens; identical to SEQ ID NO: 876

SEQ ID NO: 882 - DNA, 141 bp, Homo sapiens; identical to SEQ ID NO: 876

SEQ ID NO: 883 - DNA, 105 bp, Homo sapiens
aaattttgaaccattccctagtcatttccaaacttgaaaacagaatcagtgttaaattcattttattcttattaaggaaatactttgcataaattaatcagcccc

SEQ ID NO: 884 - DNA, 105 bp, Homo sapiens; identical to SEQ ID NO: 883

SEQ ID NO: 885 - DNA, 105 bp, Homo sapiens; identical to SEQ ID NO: 883

SEQ ID NO: 886 - DNA, 105 bp, Homo sapiens; identical to SEQ ID NO: 883

SEQ ID NO: 887 - DNA, 105 bp, Homo sapiens; identical to SEQ ID NO: 883

SEQ ID NO: 888 - DNA, 105 bp, Homo sapiens; identical to SEQ ID NO: 883

SEQ ID NO: 889 - DNA, 105 bp, Homo sapiens; identical to SEQ ID NO: 883

SEQ ID NO: 890 - DNA, 244 bp, Homo sapiens
cagacaggctggcattctagattacttttcttactctgaaacatggcctgtttgggagtgcgggattcaaaggtggtcccacggctgcccctactgcaaatggcagttttaatcttatcttttggcttctgcagatggttgcaattgatccttaaccaataatggtcagtcctcatctctgtcgtgcttcataggtgccaccttgtgtgtttaaagaagggaagctttgtacctttagagtgta

SEQ ID NO: 891 - DNA, 244 bp, Homo sapiens; identical to SEQ ID NO: 890

SEQ ID NO: 892 - DNA, 244 bp, Homo sapiens; identical to SEQ ID NO: 890

SEQ ID NO: 893 - DNA, 244 bp, Homo sapiens; identical to SEQ ID NO: 890

SEQ ID NO: 894 - DNA, 244 bp, Homo sapiens; identical to SEQ ID NO: 890

SEQ ID NO: 895 - DNA, 244 bp, Homo sapiens; identical to SEQ ID NO: 890

SEQ ID NO: 896 - DNA, 244 bp, Homo sapiens; identical to SEQ ID NO: 890

SEQ ID NO: 897 - DNA, 156 bp, Homo sapiens
agtcagcctggaattcttactttcacgccgctattcttttcctttctccgtgattgcttggctagccatttaaaaaaaaatattctctgttcagtgtatatgttgcttgtttgttttatttattgagatatttttacaagctaagtgactgcagtg

SEQ ID NO: 898 - DNA, 288 bp, Homo sapiens
tctaaaccacattggaactgacctgaagaagcaaactcggaaaatataataacatccctgaattcaggacttccacaagatgcagaacaaaatggataaaaggtatttcactggagaagttttaatttctaagtaaaatttaaatcctaacacttcactaatttataactaaaatttctcatcttcgtacttgatgctcacagaggaagaaaatgatgatggtttttattcctggcatccagagtgacagtgaacttaagcaaattaccctcctacccaattctatgg

SEQ ID NO: 899 - DNA, 59 bp, Homo sapiens
tattttcatatccagcctaaaggtggttgtttattatatagtaataaatcattgctgta

SEQ ID NO: 900 - DNA, 335 bp, Homo sapiens
tcttttctaagagtcaaccacaggcatttaagtcagccaaagaatattgttaccttaaagcactattttatttatagatatatctagtgcatctacatctctatactgtacactcacccataattcaaacaattacaccatggtataaagtgggcatttaatatgtaaagattcaaagtttgtctttattactatatgtaaattagacattaatccactaaactggtcttcttcaagagagctaagtatacactatctggtgaaacttggattctttcctataaaagtgggaccaagcaatgatgatcttctgtggtgcttaaggaaacttacta

SEQ ID NO: 901 - DNA, 109 bp, Homo sapiens
tgcaatgcttgtgctcgtgaagtcattatcaggaccaagagaacatatcgtggacctggagatgctgacagtcagcagtatagggaccttccgcacaagctctgtgtta

SEQ ID NO: 902 - DNA, 110 bp, Homo sapiens
acaaatacatgagcatccgatctgataggtctgtgccatcagacatcttccagatacaggccacaactatttatgccaacaccatcaatacttttcggattaaatctgga

SEQ ID NO: 903 - DNA, 85 bp, Homo sapiens
accacaaatgaatgccgggaggatgaaatgtgttggaattatcatggcggcttccgttgttatccacgaaatccttgtcaagatc

SEQ ID NO: 904 - DNA, 100 bp, Homo sapiens
gaacctcaagctacctgtgtcaatatcaatgtgtcaatgaacctgggaaattctcatgtatgtgcccccagggataccaagtggtgagaagtagaacatg

SEQ ID NO: 905 - DNA, 80 bp, Homo sapiens
gtgctacaacattcttggttcattcatctgtcagtgcaatcaaggatatgagctaagcagtgacaggctcaactgtgaag

SEQ ID NO: 906 - DNA, 112 bp, Homo sapiens
tgaatgtaccatccctccatattgccaccaaagatgcgtgaatacaccaggctcattttattgccagtgcagtcctgggtttcaattggcagcaaacaactatacctgcgta

SEQ ID NO: 907 - DNA, 84 bp, Homo sapiens
catagacgagtgcactgcagggacgcacaactgtagagcagaccaagtgtgcatcaatttacggggatcctttgcatgtcagtg

SEQ ID NO: 908 - DNA, 132 bp, Homo sapiens
ctgctgcagtcgcaggccctgaaatgcagactggccgaaataactttgtcatccggcggaacccagctgaccctcagcgcattccctccaacccttcccaccgtatccagtgtgcagcaggctacgagcaaa

SEQ ID NO: 909 - DNA, 30 bp, Homo sapiens
gcaaccaccggggttgtagctgccagcagc

SEQ ID NO: 910 - DNA, 115 bp, Homo sapiens
gtgacattgtcccagacgcttgtaaaggtggaatgaagtgtgtcaaccactatggaggatacctctgccttccgaaaacagcccagattattgtcaataatgaacagcctcagca

SEQ ID NO: 911 - DNA, 39 bp, Homo sapiens
aatgcactgacggatatgagtgggatcctgtgagacagc

SEQ ID NO: 912 - DNA, 228 bp, Homo sapiens
cggttcagcgggattctgtgacaaaaaaagactttacacacccctgccagtgtatttgggctatactctgctgagggtgataaattaaacaacacttcattcatgcttcatatctaagattcgttgtaaattgcccccttgatcctttcaaaagttcattgggctcaccacctaagataggaaccaacatgtaatcatttgtgcagggctaaaaatgggatccgttca

SEQ ID NO: 913 - DNA, 26 bp, Homo sapiens
acaccgaagaaaccatcacgtacacg

SEQ ID NO: 914 - DNA, 246 bp, Homo sapiens
tgcagcctgctttgtaggtgcagtataaaatgcacgctgaatgtcttttgtatgtaaacagcgtagcaggatggagtaacgtgaaatgcaattctacagcagtttttacgtctttgctgcctcgttcgttggctaccgagaaggttcaggagggggaggggagatgagaaagcagattggaagttgagtatggtggagcctcagcctctcccaccctcctttcctcgcttgtgctcactgctaaag

SEQ ID NO: 915 - DNA, 42 bp, Homo sapiens
cgctgccggacttcgccagatcagacccacggggctgccctc

SEQ ID NO: 916 - DNA, 259 bp, Homo sapiens
ttgaggccttacagttttgtatctacatttttcccctcctggggtttgcggggacagggacagaactacaggagtcatgggaaagaaaattctggcttcactactgctcactgctcactttctgatcactctgatacttttttttttttttttttttttgcaacctgataccttgaaaagcttctatgtgtctctccttttgttgcctggcagctgtctaggatgatcactgattactatttactaagtagccacatgc

SEQ ID NO: 917 - DNA, 1347 bp, Homo sapiens
gactgagcgatgacaccacactttgtttggacatttaaattcactctgctgaataggaggaagcttttctttttcctgggaaaacaactgtctcttggaattatctgaccatgaacttgctcttctagacaactcacatcaaagccctcactccactaatggagaatcctagccccactaatgccaagtctgtttggggattttgcctcagctatgggcttccctagagtaggtctaggggaatactcagtctgatcttttttttgtttgttttattttgttttttttgagacggagtctcgctcttcctccaaggctggagtgcagtgacgcgatctccactcactgcaggctccgcctcccgggttcccgccattctcctgcctcagcctcccgagtagccgggactacaggcgcccaccaccgtgcccggctaatttagttgtatttttagtagagatggggtttcaccgtattagccaggatggtctcgatctcctgacctcgtgatccgcccgcctcggcctcccaaagtgctgggattacaggcgtgagccaccgcgcccggcctgattctcttaaaattgaagaggtgctgccaaggccttcagatctaacgcagatgcatagaccttgttcctggtacttgttcagcctgtgctggggagccgtggtcccgagttccctgggaggctgacagggtcaagccaccctgcccaccaccctcccacttcccctcccctttcctctccagcattaggattcaagggaaatttgcatgaagccaattttgagggtagacgtgtggggaaaataaatcattatacagtaagacctggggcttgaggggtggggaatggggagggaagggcatagcctgctcctccatgagtctgacatctcggaaactgagcagctgccggacgcctgggtcaggaatccaagaccccacctcttaaggactggttcctcagaaagcaccctcagggaaaaaggtgaaaacattacatccgtggattctcctgccacaaccgcattggaagaaaaggctgccgcaacatctcagcgaggagtgaaggacccatgtcccaggaaccgcgctgcgccacctgcactcacccccctcacattctcttaagcacccggtggccctccgaggcctggcggaatggtggtgcccacggggttgggcaagggctcaccaggacctcaacgggcaaagttgtgcacactaaaatatcaaatcaaggtgcttggttttaaagtaaatgtttttctaaagaaagctgtgctcttctgttgacccagacgaatagggcacagccctgtaactgcacgtgccttctg

SEQ ID NO: 918 - DNA, 98 bp, Homo sapiens
tcctgtacatgagcgctgccgtcctacaagtacatgccacgattgtttctgagaaactgctggacccaagaatttactacattaattcggcagcctcg

SEQ ID NO: 919 - DNA, 39 bp, Homo sapiens
atggtagccgccacccacatagtataccccttgctgcaa

SEQ ID NO: 920 - DNA, 62 bp, Homo sapiens
ccgccaccagctacgccccgtccgacgtgccctcgggggtcgcgctgttcctcaccatccct

SEQ ID NO: 921 - DNA, 373 bp, Homo sapiens
ctgtctgcagatagcttggctcattgttggtcctcagtacgcagccctcgtagccaagcagcttgggcctacactctgggcccaggggagtggctgtcgctggcatcccctggaataacatgctccgggggtcaaagattccttagctggaaaggtctaggaggagactcccgctctgctccctcctgcaccagcgctgtgccccccgccggccaggcagagccatccgatgccgctgggccgcccactgaggatctgctggctgcagcgagtggaaggacctgctcggctggaacgttttttttttttttccctcccaggcgacgtccgatgggtgtgtcgggcaggaggtgatatttgacaggctgcgcgc

SEQ ID NO: 922 - DNA, 28 bp, Homo sapiens
atgaggggcttccagctgctctgtgcag

SEQ ID NO: 923 - DNA, 33 bp, Homo sapiens
cctgcaagggaaataaaaatgactaagatatta

SEQ ID NO: 924 - DNA, 125 bp, Homo sapiens
taaaattgctagtttaccgttcagaagtataatagaaataatctttagttgctcttttctaaccattgtaattcttcccttcttccctccacctttccttcattgaataaacctctgttcaaaga

SEQ ID NO: 925 - DNA, 140 bp, Homo sapiens
tttgatataagacaccttcgggggaaataattcctgtgaatattctttttcaattcagcaaacatttgaaaatctatgatgtgcaagtctaattgttgatttcagtacaagattttctaaatcagttgctacaaaaactg

SEQ ID NO: 926 - DNA, 82 bp, Homo sapiens
acttagtatgcagttgataagaggaatttggtataattatggtgggtgattattttttatactgtatgtgccaaagctttac

SEQ ID NO: 927 - DNA, 213 bp, Homo sapiens
ttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgccta

SEQ ID NO: 928 - DNA, 35 bp, Homo sapiens
gttctgcttcgaagtattcaataccgctcagtatt

SEQ ID NO: 929 - DNA, 27 bp, Homo sapiens
tgttagcagacccagcttagagttctt

SEQ ID NO: 930 - DNA, 31 bp, Homo sapiens
tctctgccaagatccatctaaactggagtga

SEQ ID NO: 931 - DNA, 26 bp, Homo sapiens
ctgacagagaagattcccgagagtaa

SEQ ID NO: 932 - DNA, 32 bp, Homo sapiens
tgttaattgcccaattgagtgcttcatgcctt

SEQ ID NO: 933 - DNA, 76 bp, Homo sapiens
gctgtgacaactgccgcagacctgggggtgaacccagtcccgaaggcactactggccagtcctacaaccagtattc

SEQ ID NO: 934 - DNA, 165 bp, Homo sapiens
ctgacctccatgagcttgctttaccccctgccagcttaagaacagtagtgaaagagaacatgtgtgtcctcccatttccagtaaaaacttcaggcaggagcctcactggctcagcttggtcccgtttccatctcccatgccatctccggccaggtgacaggctac

SEQ ID NO: 935 - DNA, 323 bp, Homo sapiens
gccaggctccctacaagttagataagataaagggtgggctcctgcaaggatgtgtcgtacacacaggaggggcagagacccttcggaagtattaaaataccacatttcctgttggcatacaactgctgacatagagctctagagcagctctatgtctaccttacatgccattcattctttctattactcttagtagaaagaatgaatgaatggcatgtagagtaccaaaaacacaagtcttgagtcattcttaatagcaacacctgtcatttatatgatgttagaatcattttcctaagctccctagcatgtcagagatacta

SEQ ID NO: 936 - DNA, 79 bp, Homo sapiens
tgatgggaagacataccacgtaggagaacagtggcagaaggaatatctcggtgccatttgctcctgcacatgctttgga

SEQ ID NO: 937 - DNA, 28 bp, Homo sapiens
gatggtgccatgacaatggtgtgaacta

SEQ ID NO: 938 - DNA, 38 bp, Homo sapiens
aaactgttgtgccagtgcttaggctttggaagtggtca

SEQ ID NO: 939 - DNA, 110 bp, Homo sapiens
cactctgacaggcctcaccagaggtgccacctacaacgtcatagtggaggcactgaaagaccagcagaggcataaggttcgggaagaggttgttaccgtgggcaactctg

SEQ ID NO: 940 - DNA, 67 bp, Homo sapiens
caagaagctctctctcagacaaccatctcatgggccccattccaggacacttctgagtacatcattt

SEQ ID NO: 941 - DNA, 79 bp, Homo sapiens
aggaaatccaaattggtcacatccccagggaagatgtagactatcacctgtacccacacggtccgggactcaatccaaa

SEQ ID NO: 942 - DNA, 164 bp, Homo sapiens
cacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgc

SEQ ID NO: 943 - DNA, 34 bp, Homo sapiens
cttcatggaccagagatcttggatgttccttcca

SEQ ID NO: 944 - DNA, 76 bp, Homo sapiens
ccgggaaccgaatatacaatttatgtcattgccctgaagaataatcagaagagcgagcccctgattggaaggaaaa

SEQ ID NO: 945 - DNA, 67 bp, Homo sapiens
cacacccaattccttgctggtatcatggcagccgccacgtgccaggattaccggctacatcatcaag

SEQ ID NO: 946 - DNA, 88 bp, Homo sapiens
ttacaaccaggcactgactacaagatctacctgtacaccttgaatgacaatgctcggagctcccctgtggtcatcgacgcctccactg

SEQ ID NO: 947 - DNA, 105 bp, Homo sapiens
caagaagggctcgtgtgacagatgctactgagaccaccatcaccattagctggagaaccaagactgagacgatcactggcttccaagttgatgccgttccagcca

SEQ ID NO: 948 - DNA, 65 bp, Homo sapiens
gtgagtgtctatgctcttaaggacactttgacaagcagaccagctcagggagttgtcaccactct

SEQ ID NO: 949 - DNA, 181 bp, Homo sapiens
ctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcagg

SEQ ID NO: 950 - DNA, 1027 bp, Homo sapiens
caaactcgggcatttcatagcagcatgattctgagcacacgtgggtaagacctttcttctctggttagatatcatatgctggtgtataattagcttaaatgattgtgatttagacacctaggaaataatcaatagggcaattgctttccataatactttatcttcttgtgctttatttctgaagcagagtagaatgctaaagatgtatcctagtgacagcataaaccctagaggtgacagtctgtattattgcttttcgcttctcttttctgcttctgttgggagccagttttcttcttacgccgcattacagagagaacgtcaaatttagcagccatatctgccatagggtccaaataaagagacaataaaaacattattctctcttttttggatggaatactgcgtgaaatggttatccatacaaagatactttatgtagaatagaaaaaggaggccgggtgcagtggctcacacatgtaatcctagtgctttgggaggctaagccgggagcactgattgaggccaggagttcatgatcagcctgggcaatgaagtgagaccccgtctctacaaaaaaatatgaaaaaattagcgaggtgtggtgacacatgcctgtagtcccagctactcaagaggctgaggtagaggatcacttgagcctacgagttcaaggctgcagtgagctatgataactccactgcactgccgcctggatgacacagagagaccgtttctaaattaattaattaacaattttaagaaagaaaaagggccattgcttatttttccatacaaaagtaaaataaatcataatggccaataagccaatgtaacttttttttttaagggaaagcaaaacttgtaaaacctaaaatctcttagagttttggcatttacccaaatgttttcagtgattctgagaattggtggatataaaacacatttctcagcaaacactttcttcattttgcatcccttactgtacgtactttcttgtactgaatctttgcttgaccagggaacc

SEQ ID NO: 951 - DNA, 243 bp, Homo sapiens
tgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcc

SEQ ID NO: 952 - DNA, 215 bp, Homo sapiens
gtctgaatgcccacgacatgtcttttgcaattacacatagggaaagtgaacttgttggttagtttatgtcttgagctgagccctttacgaacatcttttttccttctcagtgccaagcgaggaatttacagagaaagaagttgtgaaaccaccatagttagttgctgtgctttgaatttcttttgctcaaatggcctcagcgaaatcttatttgc

SEQ ID NO: 953 - DNA, 63 bp, Homo sapiens
gcccacagtggagtatgtggttagtgtctatgctcagaatccaagcggagagagtcagcctct

SEQ ID NO: 954 - DNA, 131 bp, Homo sapiens
ttgacaaaccatcccagatgcaagtgaccgatgttcaggacaacagcattagtgtcaagtggctgccttcaagttcccctgttactggttacagagtaaccaccactcccaaaaatggaccaggaccaaca

SEQ ID NO: 955 - DNA, 70 bp, Homo sapiens
tgggagcaagtctacagctaccatcagcggccttaaacctggagttgattataccatcactgtgtatgct

SEQ ID NO: 956 - DNA, 479 bp, Homo sapiens
tctgttgtggataacctgaaagcccaacagtgaacaaagaattaaagaaactttggcaagtccattcaacggagcccttgttttttccaagaaaatacgtaagatatagatgatataatttgttctaaaacccaaataaaaagttgtttatatactacaactagagggggaacggcagagctgaggaaataaaaggattgtaaattcacaaacatattatcagtggtggaaataagtgatttttattttttcttctctttacttttctgtattttccaaattttatttaaaaggaatgtattctgttaaaagttttaaaaaggacacaatgcatgcaatcctgggttgagggcttaccttctcccacttctaatgctactctactactcagtgacattttaaagctgaaatgttaaaacagcgctaactgtaattttctctcaatgtttatacacttaccaaggtttgctacatgcata

SEQ ID NO: 957 - DNA, 96 bp, Homo sapiens
ggacctggaagttgttgctgcgacccccaccagcctactgatcagctgggatgctcctgctgtcacagtgagatattacaggatcacttacggaga

SEQ ID NO: 958 - DNA, 222 bp, Homo sapiens
ccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcaga

SEQ ID NO: 959 - DNA, 64 bp, Homo sapiens
cagaatatgtagtgagtgtctccagtgtctacgaacaacatgagagcacacctcttagaggaag

SEQ ID NO: 960 - DNA, 168 bp, Homo sapiens
ctgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaa

SEQ ID NO: 961 - DNA, 160 bp, Homo sapiens
tcactgaatggaactgtagctctagatatctcacatggggggaagtttaggaccctcttgtctttttgtctgtgtgcatgtatttctttgtaaagtactgctatgtttctctttgctgtgtggcaacttaagcctcttcggcctgggataaaataatctg

SEQ ID NO: 962 - DNA, 559 bp, Homo sapiens
acatagatggtgttgcatgctgccaccagttactccggttaaatatggatgtttcatgggggaagtcagcaattggccaaagattcagatagggtggattggggggataaggaatcaaatgcatctgctaaactgattggagaaaaacacatgcaagtattcttcagtacactctcatttaaaccacaagtagatataaagctagagaaatacagatgtctgctctgttaaatataaaatagcaaatgttcattcaatttgaagacctagaatttttcgtcttaaataccaaacacgaataccaaattgcgtaagtaccaattaattataagaaatatatcaccaaaatgtaccatcatgatcttccttctaccctttgataaactctaccatgctccttctttgtagctaaaaacccatcaaaatttagggtagagtggatgggcattgttttgaggtaggagaaaagtaaacttgggagcattctaggttttgttgctgtcactaggtaaagaaacacctctttaaccacagtctggggacaagcatgcaacatttt

SEQ ID NO: 963 - DNA, 148 bp, Homo sapiens
ttgggtaccgcatcacagtagttgcggcaggagaaggtatccctatttttgaagattttgtggactcctcagtaggatactacacagtcacagggctggagccgggcattgactatgatatcagcgttatcactctcattaatggcgg

SEQ ID NO: 964 - DNA, 203 bp, Homo sapiens
cttcagatattatgtctaggctctaagaatggttttgacatcctaaacagccatatgatttttaggaatctgaacagttcaaattgtaccctttaaggatgttttcaaaatgtaaaaaatatatatatatatatattccctaaaagaatattcctgtttattcttctagggaagcaaactgttcatgatgcttaggaagtctt

SEQ ID NO: 965 - DNA, 30 bp, Homo sapiens
gtgtccctatctctgataccatcatcccag

SEQ ID NO: 966 - DNA, 126 bp, Homo sapiens
cctacaaacggccagcagggaaattctttggaagaagtggtccatgctgatcagagctcctgcacttttgataacctgagtcccggcctggagtacaatgtcagtgtttacactgtcaaggatgac

SEQ ID NO: 967 - DNA, 26 bp, Homo sapiens
gcaaaccctgacactggagtgctcac

SEQ ID NO: 968 - DNA, 134 bp, Homo sapiens
gaggcaccacgagaagtgacttcagactcaggaagcatcgttgtgtccggcttgactccaggagtagaatacgtctacaccatccaagtcctgagagatggacaggaaagagatgcgccaattgtaaacaaagt

SEQ ID NO: 969 - DNA, 79 bp, Homo sapiens
tctattccaccttacaacaccgaggtgactgagaccaccattgtgatcacatggacgcctgctccaagaattggtttta

SEQ ID NO: 970 - DNA, 188 bp, Homo sapiens
gaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaa

SEQ ID NO: 971 - DNA, 150 bp, Homo sapiens
gacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtc

SEQ ID NO: 972 - DNA, 106 bp, Homo sapiens
tattcgccatcagtagaaggtagcagcacagaactcaaccttcctgaaactgcaaactccgtcaccctcagtgacttgcaacctggtgttcagtataacatcacta

SEQ ID NO: 973 - DNA, 65 bp, Homo sapiens
tgatgcccctcctgacacgactgtggaccaagttgatgacacctcaattgttgttcgctggagca

SEQ ID NO: 974 - DNA, 90 bp, Homo sapiens
tccaagcacagccacttctgtgaacatccctgacctgcttcctggccgaaaatacattgtaaatgtctatcagatatctgaggatgggga

SEQ ID NO: 975 - DNA, 138 bp, Homo sapiens
acaggagagacgactcccttttctcctcttgtggccacttctgaatctgtgaccgaaatcacagccagtagctttgtggtctcctgggtctcagcttccgacaccgtgtcgggattccgggtggaatatgagctgagt

SEQ ID NO: 976 - DNA, 125 bp, Homo sapiens
aggctctcctgaggcaatgctttccttctcaattcatattcttccaggaggggcaccaacgttttttaaaatgatgttggcgacgaggacggtaaattttctagatgactgaaggctgactttcc

SEQ ID NO: 977 - DNA, 139 bp, Homo sapiens
tggaaggaagctaccataccaggccacttaaactcctacaccatcaaaggcctgaagcctggtgtggtatacgagggccagctcatcagcatccagcagtacggccaccaagaagtgactcgctttgacttcaccacca

SEQ ID NO: 978 - DNA, 87 bp, Homo sapiens
atcttatcaattctgatggtttctttttttcccagcttttgagccaacaactctgattaactattcctatagcatttactatatttg

SEQ ID NO: 979 - DNA, 33 bp, Homo sapiens
gtgagtatcccacccagaaaccttggatactga

SEQ ID NO: 980 - DNA, 101 bp, Homo sapiens
gacgttttatcaaattggagattcatgggagaagtatgtgcatggtgtcagataccagtgctactgctatggccgtggcattggggagtggcattgccaac

SEQ ID NO: 981 - DNA, 84 bp, Homo sapiens
tgacatcacttacaatgtgaacgacacattccacaagcgtcatgaagaggggcacatgctgaactgtacatgcttcggtcaggg

SEQ ID NO: 982 - DNA, 213 bp, Homo sapiens
ggcttctcacaggaaagtgtattttaccacattctttacttgagcatactgtaacctctgcaaaagttacacattttgggaagaaaaaaatttttttggcaaaaattgtattactgaccaaactttgaaaaaaatgttattctatgcttgtagaaaagttattttagtggaaggtgttgataattaagtggaagtagttgtatgctttgagaa

SEQ ID NO: 983 - DNA, 145 bp, Homo sapiens
ggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcga

SEQ ID NO: 984 - DNA, 110 bp, Homo sapiens
ccttcctatacaacaaccacaattacactgattgcacttctgagggcagaagagacaacatgaagtggtgtgggaccacacagaactatgatgccgaccagaagtttggg

SEQ ID NO: 985 - DNA, 65 bp, Homo sapiens
catctttggtgcagcacaacttcgaattatgagcaggaccagaaatactctttctgcacagacca

SEQ ID NO: 986 - DNA, 32 bp, Homo sapiens
tggcaggacgttctactcctgcaccacagaag

SEQ ID NO: 987 - DNA, 56 bp, Homo sapiens
cagacttacggtggcaactcaaatggagagccatgtgtcttaccattcacctacaa

SEQ ID NO: 988 - DNA, 118 bp, Homo sapiens
ccactgtgtcacagacagtggtgtggtctactctgtggggatgcagtggctgaagacacaaggaaataagcaaatgctttgcacgtgcctgggcaacggagtcagctgccaagagaca

SEQ ID NO: 989 - DNA, 48 bp, Homo sapiens
tctggccccttcaccgatgttcgtgcagctgtttaccaaccgcagcct

SEQ ID NO: 990 - DNA, 143 bp, Homo sapiens
atgcaacgatcaggacacaaggacatcctatagaattggagacacctggagcaagaaggataatcgaggaaacctgctccagtgcatctgcacaggcaacggccgaggagagtggaagtgtgagaggcacacctctgtgcaga

SEQ ID NO: 991 - DNA, 110 bp, Homo sapiens
gacttcctatgtggtcggagaaacgtgggagaagccctaccaaggctggatgatggtagattgtacttgcctgggagaaggcagcggacgcatcacttgcacttctagaa

SEQ ID NO: 992 - DNA, 125 bp, Homo sapiens
ccatgaagggggtcagtcctacaagattggtgacacctggaggagaccacatgagactggtggttacatgttagagtgtgtgtgtcttggtaatggaaaaggagaatggacctgcaagcccatag

SEQ ID NO: 993 - DNA, 101 bp, Homo sapiens
acacttaccgagtgggtgacacttatgagcgtcctaaagactccatgatctgggactgtacctgcatcggggctgggcgagggagaataagctgtaccatc

SEQ ID NO: 994 - DNA, 84 bp, Homo sapiens
atcaacagtgggagcggacctacctaggcaatgcgttggtttgtacttgttatggaggaagccgaggttttaactgcgagagta

SEQ ID NO: 995 - DNA, 54 bp, Homo sapiens
gaggcaggctcagcaaatggttcagccccagtccccggtggctgtcagtcaaag

SEQ ID NO: 996 - DNA, 97 bp, Homo sapiens
gcgacaacccccgggaggcattagaagggatttttcccgcaggttgcgaagggaagcaaacttggtggcaacttgcctcccggtgcgggcgtctctc

SEQ ID NO: 997 - DNA, 59 bp, Homo sapiens
gaccgtcccatataagccccggctcccggcgctcggacgcccgcgccggctgtgctgca

SEQ ID NO: 998 - DNA, 50 bp, Homo sapiens
cctggggcgcttgggtcggcctcgaggacaccggagaggggcgccacgcc

SEQ ID NO: 999 - DNA, 150 bp, Homo sapiens
agtcgtggtactttacgcctcggtgtttagggaggagcctaaggtaaggagtcagaaacggggagtaaccgagctgcggcttttatataaggtcagtggtaggtaaggaaggggccttaacctctgctggtgaccagaagcctgcatttc

SEQ ID NO: 1000 - DNA, 26 bp, Homo sapiens
gtgtaggaagaatgtttatttttcag

SEQ ID NO: 1001 - DNA, 27 bp, Homo sapiens
ttagagaagcagcaaatagcgaagaaa

SEQ ID NO: 1002 - DNA, 26 bp, Homo sapiens
acagcaaacccctattccatgctgtt

SEQ ID NO: 1003 - DNA, 63 bp, Homo sapiens
ctctgggagattctcctattgacccagaaagcgattccttcactgatacactgtctgcaaaca

SEQ ID NO: 1004 - DNA, 166 bp, Homo sapiens
ccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatga

SEQ ID NO: 1005 - DNA, 150 bp, Homo sapiens
gtgcaatcaaagtggagcctgcatctccaccttattattctgagaagactcagctctacaataagcctcatgaagagccttccaactccctcatggcaattgaatgtcgtgtctgtggagataaagcttctggatttcactatggagttc

SEQ ID NO: 1006 - DNA, 39 bp, Homo sapiens
tttcttccggagaacaatcagattgaagcttatctatga

SEQ ID NO: 1007 - DNA, 95 bp, Homo sapiens
gatgtgatcttaactgtcggatccacaaaaaaagtagaaataaatgtcagtactgtcggtttcagaaatgccttgcagtggggatgtctcataat

SEQ ID NO: 1008 - DNA, 120 bp, Homo sapiens
ctgttggcggagatctccagtgatatcgaccagctgaatccagagtccgctgacctccgggccctggcaaaacatttgtatgactcatacataaagtccttcccgctgaccaaagcaaag

SEQ ID NO: 1009 - DNA, 234 bp, Homo sapiens
taaatggtttactgcgctacaaatgcacacacagaatattgttcaactgttggctgttaacatattgcaggctgagtctgaaacgcaggaagtgttttcagatagcacaagtcaacattattttgaaaagggagaaaagtccataaagtttttgagaatagtgtaacaatgtattggtcatcctaactttaatgaatgaacttaagccccctgagcctatcaccctcttttagg

SEQ ID NO: 1010 - DNA, 131 bp, Homo sapiens
tggagtccacgagatcatttacacaatgctggcctccttgatgaataaagatggggttctcatatccgagggccaaggcttcatgacaagggagtttctaaagagcctgcgaaagccttttggtgacttta

SEQ ID NO: 1011 - DNA, 129 bp, Homo sapiens
gacaacctgctacaagccctggagctccagctgaagctgaaccaccctgagtcctcacagctgtttgccaagctgctccagaaaatgacagacctcagacagattgtcacggaacacgtgcagctactg

SEQ ID NO: 1012 - DNA, 48 bp, Homo sapiens
gtgatcaagaagacggagacagacatgagtcttcacccgctcctgcag

SEQ ID NO: 1013 - DNA, 31 bp, Homo sapiens
tccagttgcactattctgagggaaaatctga

SEQ ID NO: 1014 - DNA, 163 bp, Homo sapiens
ccaaagaagcgactagggacccaagtttaaaaattcctccccccacccaatgcgagacgtggccagatcccatccaacacacggtttaattttcatggggctctgggatcaaaagaacagaaacagcaacaacaaaagcccagccgctgtctgattttaagct

SEQ ID NO: 1015 - DNA, 72 bp, Homo sapiens
gagcattaagcagtatctcccagcattgttagctactgagtggcacatcttcagtacgcatgattcgtgggg

SEQ ID NO: 1016 - DNA, 31 bp, Homo sapiens
aacttttcagcattacctaagaagcaaaggc

SEQ ID NO: 1017 - DNA, 50 bp, Homo sapiens
ttctaacgtgcctgatctactgagaccaaggatgaccaatgactcagaag

SEQ ID NO: 1018 - DNA, 170 bp, Homo sapiens
agaggtcatgccctccctggaaccttcttttttattattggtctttggtggtgtacaaagagtattctgaagtatatctgcaaaaagcaaaagcgaacctgctatcttggttccaaaacattattctatcgattggaaattttggagggaattacaatagttggcatggc

SEQ ID NO: 1019 - DNA, 30 bp, Homo sapiens
taaacaaggtcactggaatcaactcctggg

SEQ ID NO: 1020 - DNA, 78 bp, Homo sapiens
ttgggtgtggcagatatcttatgtttcaccatcagttcacttcctgtgtccttaaccaagttaatgttgtcaaatgcc

SEQ ID NO: 1021 - DNA, 150 bp, Homo sapiens
actcatggccgggaaatgctggacatctttgtgcaccagctgctggttttggtcgtctttctgacaggcctcgttgccttcctagagttccttgttcggaacaatgtacttctggagctattgcggtcaagtctcattctgcttcagggg

SEQ ID NO: 1022 - DNA, 59 bp, Homo sapiens
ttggatttgtcctgtatccccccagtggaggtcctgcatgggatctgatggatcatgaa

SEQ ID NO: 1023 - DNA, 27 bp, Homo sapiens
gctgacttctgggcctcatctccttag

SEQ ID NO: 1024 - DNA, 120 bp, Homo sapiens
gccagcatccaaggaaatgctcttcctcatgtcagctcccctccagagccaaaagaagactactgtctcttcctgtttcaaaacgcttcatacccctaatgggcctcttatccacttata

SEQ ID NO: 1025 - DNA, 402 bp, Homo sapiens
cctccacctggcatattcacattaaatgcacgtcttttctatgaaaacttctgtggtgactctagctcttgctcatctccctttaagagtttttgttttttttttcaaatacaccacaaaagattttattatgaaaaacatatgggtaaaatgtagcaactatgcggtttacaaaatgttctattattgcataaaactatctttggtctatcaccttctaaaacttcttacactctttcttggtgttaggtcaaatctgcaaatgctttatctgttctccatatcattagagctccatcttccacaaatattttaagatagaccttccctccacaatcattactcccacagtcttaatgtaaccagtgaacatggacagcagccgtccaatatacattcaca

SEQ ID NO: 1026 - DNA, 3278 bp, Homo sapiens
caacaagtattgtttactgcacatatataaagatgatttaatattgaaaaatttattaattaaatgcaccctaatgataggtccagtttcttatgattaagaaacaccataaggtgatcttaatagctacttaagaaacattcgatacaatttaaactgatttgtttacctcttagaaaacaagaatgaagtttttgtatgataagcaatattctttttttaaaaattttattattattatactttaagttttagggtacatgtgcacaacatgcaggtttgttacatatgtatacatgtgccatgttggtgtgctgcacccgttaactcatcatttagtgttaggtatatctcctaatgctatccctcccccctatcgacaccccacaacagtccccggtgtgtgatgttccccttcttgtgtccatgtgttctcattgttcaattcccacctatgagtgagaatatgcggtgtttggttttttgttcttgcgatagtttgctgagaatgatggtttccagtttcatccatgtccctacaaaggacatgaactcatcattttttatggctgcatagtattccatggtgtatatgtgccacattttcttaatccaatctatcgttgttggacatttaggttggttccaagtctttgctattgtgaatagtgccacagtaaacatacatgtgcatgtgtctttatagcagcatgatttataatcctttgggtatatacccagtaatgggatggctggatcaaatggtatttctagttctagatccctgaggaatcgccacactgacttccacaatggttgaactagtttacagtcccaccaacagtgtaaaagtgttcctatttctccacaacctctccagcacctgttgtttcctgactttttaatgatcgccattctaactggtgtgagatggtatctcattgtggttttgatttgcatttctctgatggccagtgatggtgagcattttttcatgtgttttttggctacataaatgtcttcttttgagaagtgtctgttcatatccttcgcccactttttgatggggttgtttgtttttttcttgtaaatttgtttgagttcattgtagattctggatactagccctttgtcagatgagtaggttgtgaaaattttctcccattctgtaggttgcctgttcactctcatggtagtttcttttgctgtgcagaagctctttagtttaattagatcccatttgtcaattttgtcttttgttgccattgcttttggtgttttcgacatgaagtccttgcccatgcctatgtcctgaatggtattgcctaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattggtctatatctctgttttggtaccagtaccatgctgttttggtgactgtagccttgtagtatagtttgaagtcaggtagcatgatgcctccagctttgttcttttggcttaggattgacttggcgatgcgggctcttttttggttccatatgaactttaaagcagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttaattcatgatttggctctctgtttgtctgttattggtgtataagaatgcttgcgatttttgtacattgattttgtatcctgagactttgctgaagttgcttatcagcttaaggagcttttgggctgagctgatggggttttctagatatacaatcacgtcatctgcaaacagggacaatttgacctcctgttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctatgggtttcatagatagcttttattattttgagatacgtcccatcaatacctaatttattgagagtttttagcatgaagggttgttgaattttgtcaaaggccttttctgcatctattgagataatcatgtggtttttgtcgttggttctgttatatgctggattacatttattgatttgtgtatgttgaaccagccttgcatcccagggatgaagcccacttgatcatggtggataagctttttgatgtgctgctggattcggtttgccagtattttattgaggatttttgcatccatgttcatcaaggatattggtctaaaattttcttttttggttatgtctctgccagcctttggtatcaggatgatgctggcctcatgaaatgagttagggaggattccctctttttctattgattggaatagtttcagaaggaatggtacaaaaaacctttcaaaaaattaatgaatccaggagctggttttttgaaaacatcaacaaaattgatagactgctagcaagactaataaagaagaaaagagagaagaatcaaatagacgcaataaaaaatgataaaggggatgtcaccaccgatcccacagaaatacaaactaccatcagagagtactataaacacctgtatgcaaataaactagaaaatcctgaagaaatggataaattcctcgacacatacatcctcccaagactaaaccaggaagaagttgaatctctgaatagaccaataacaggctctgaaattgaggcaataatcaatagcttaccaaccaaaaaaagtccaggaccagatggattcacagccgaattctaccagaggtccctccaagaatttttacagcccgtcgtcttcaccatgcattttaacaattgggatctctcctgtgatgttcactattaggtc

SEQ ID NO: 1027 - DNA, 77 bp, Homo sapiens
ttggttaaatctagacttaagaggctctgctcctcagaagttggacttctgaaaaatgctgaacgagaacaagaatc

SEQ ID NO: 1028 - DNA, 251 bp, Homo sapiens
tggctaaggatgactctaagtgtactgtttgcatttccaatttggttaaagtatttgaatttaaatattttctttttagctttgaaaatattttgggtgatactttcattttgcacatcatgcacatcatggtattcaggggctagagtgatttttttccagattatctaaagttggatgcccacactatgaaagaaatatttgttttatttgccttatagatatgctcaaggttactgggcttgctacta

SEQ ID NO: 1029 - DNA, 62 bp, Homo sapiens
atcctaccttaagttgaagcagaccagcaattgttgtgacctacaatctccacacccatctt

SEQ ID NO: 1030 - DNA, 28 bp, Homo sapiens
tgccttcagcttgtgggaaatcccgaag

SEQ ID NO: 1031 - DNA, 56 bp, Homo sapiens
atggccaaagacaactcaactgttcgttgcttccagggcctgctgatttttggaaa

SEQ ID NO: 1032 - DNA, 110 bp, Homo sapiens
ccctgactgcggagtgcatcttctttgtatctgaccaacacagcctctacccactgcttgaagccaccgacaacgatgacatctatggggctgcctggatcggcatattt

SEQ ID NO: 1033 - DNA, 25 bp, Homo sapiens
gcatcttgtatcacagcagcaacac

SEQ ID NO: 1034 - DNA, 41 bp, Homo sapiens
tagagaggtaccaaaacaacagccctccaaacaatgatgac

SEQ ID NO: 1035 - DNA, 66 bp, Homo sapiens
gacaattgctgtggcgtaaatggtccatcagactggcaaaaatacacatctgccttccggactgag

SEQ ID NO: 1036 - DNA, 91 bp, Homo sapiens
tgctgactatccctggcctcgtcaatgctgtgttatgaacaatcttaaagaacctctcaacctggaggcttgtaaactaggcgtgcctggt

SEQ ID NO: 1037 - DNA, 49 bp, Homo sapiens
gctgctatgaactgatctctggtccaatgaaccgacacgcctggggggt

SEQ ID NO: 1038 - DNA, 42 bp, Homo sapiens
gggttctcctgggtaccatgttctactggagcagaattgaat

SEQ ID NO: 1039 - DNA, 84 bp, Homo sapiens
gctctctcctaatattccacgtttgtgccccacactaacgtgtgtgtcttacattgccaagtcagatggtacggacttccttta

SEQ ID NO: 1040 - DNA, 738 bp, Homo sapiens
ttggctagcaatctgcctgtatctctcactattatctaaaagaaaccttccaatgcttctgttgatctcagtattgtcaggggaacagagaagttgggaaaagattactgaaatataccttttgcatttctttctagagtagctcccatatatggagatgggtgattctcttgatgccaccttcagatccttttattctccagaataattcttaacagtggttcaaatttcctttcataccttgaagtatgtgtttagtagcctcaattctccattaattaaaagtgtgggctgggcgtgggggctcatgcctgtaatcccagcactttgggaggccgaggtgggcagatcacctgaggtcaggagttcaagaccagcctggccaacatggtgaaaccccgtctctacaaaaatacaaaaattagccaggcgtgatggcaggtgcctgtaatcctagctacttggcaggctaacgcaggagaatcacttgaccgggagacagaggttgcagtgagctgagatcgtacctattgcactccatcctggatgaaagagccagactctgtctcaaaacaaacaaaaaagcgtggggacttctggggacagacaaggtgcctgttatatatttactcagtctttgccctgaatggtctcagcttgagaccatttcaaactggagagaagcaagccagccaatagaatggggtgatttacagggatttctgtttactgtcaaaa

SEQ ID NO: 1041 - DNA, 32 bp, Homo sapiens
catcctgtccagcaaagaagcaatcagccaaa

SEQ ID NO: 1042 - DNA, 35 bp, Homo sapiens
tggaggcttatctgaggccaaacccgccactccag

SEQ ID NO: 1043 - DNA, 59 bp, Homo sapiens
acaaatgagacttacggaaaattggaagctgtgcagtataaaactcaagttgttgctgg

SEQ ID NO: 1044 - DNA, 534 bp, Homo sapiens
gagttcagcacctactttagcgccaaaagatgtatttctcattttatgtaaaatattccctgatttccctaccacataattccttccttacggttgtcctaaattaagatgcccagcatgattccttccaagtggtggactctcaaatttggtagatgatgtgacaccattttttttcttgtgaattcagaaagttttattacattgattcttgatttctggaaattgtatagaaaaagatttcataacagttcagggcatgctggatttgtggctgtgctgctgcttaggtaaggagggaggatcacgtctcatctgcctgaaggtgtggggctggaccacatggtatcttgaagctgattctacctcaaagctgtatgattctctatgtctaaattaaataaattaaagtaacgactcaaatcattagctgggaaaataatttaaaccttttttgcccttcaattaatataatgtaaatactattttgtaactcaaattagatttaacttgtggcactctaggcatagttta

SEQ ID NO: 1045 - DNA, 87 bp, Homo sapiens
caaaagtcttcccggacaaaatgaggacttggtacttactggataccaggttgacaaaaacaaggatgacgagctgacgggctttta

SEQ ID NO: 1046 - DNA, 79 bp, Homo sapiens
aagtgttctgattccttcaactggctactgagtcatgatccttgctgataaatataaccatcaataaagaagcattctt

SEQ ID NO: 1047 - DNA, 94 bp, Homo sapiens
gtcaagcctaatgcaactggctaaaggatagtaccaccctcacccccaccataggcaggctggatcgtggactatcaattcaccagcctccttg

SEQ ID NO: 1048 - DNA, 37 bp, Homo sapiens
tgcaggaattccagcgtttactcaaagaactgccaga

SEQ ID NO: 1049 - DNA, 33 bp, Homo sapiens
gcccaggagtatgaggccctgctgaacatcaag

SEQ ID NO: 1050 - DNA, 153 bp, Homo sapiens
tgtgttgaatgttctcgtgaagatttgtatacaaaggaaaaatttgtgctaaactggaattaaatgaaatggtaatattgcttaacttaaattttacaaataatagaacgtctgtctcaccagataaagctgtctgcaaacatgcatcaaaag

SEQ ID NO: 1051 - DNA, 175 bp, Homo sapiens
ttttaactctggaagcgcatgcacactgaactctgctcagtgctaaacagtcaccagcaggttcctcagggtttcagccctaaaatgtaaaacctggataatcagtgtatgttgcaccagaatcagcattttttttttaactgcaaaaaatgatggtctcatctctgaatttata

SEQ ID NO: 1052 - DNA, 132 bp, Homo sapiens
cctgtcgcattcacttggtctggtaccctggcaaacctcttaaagtgaagtaccactgtcaagagctacagacaccagaagaagcctccggaactgaagaaggatcagctgtagtaccaacagagcttagta

SEQ ID NO: 1053 - DNA, 26 bp, Homo sapiens
gatgatacaattgattttgattatac

SEQ ID NO: 1054 - DNA, 47 bp, Homo sapiens
gtgacagacattcaaccagactttcatataactcagtgacaagacaa

SEQ ID NO: 1055 - DNA, 91 bp, Homo sapiens
acttgtgccacaagagttacaatcaaagtggtctccttagactgaattcatgcgaacttctaatttcatatcaagagttgtaatcacattt

SEQ ID NO: 1056 - DNA, 82 bp, Homo sapiens
ggctttccttggaagctcttacgtgatgtgggaaatgacaacacaggtgtcacactactacttggcacagctcactagtgtg

SEQ ID NO: 1057 - DNA, 91 bp, Homo sapiens
ggacgtttggggaaatgttctgctcgagtgtttttcaagaatcagaaacccagaccaaccatcaatgtaacttgtacacggctcatcgaga

SEQ ID NO: 1058 - DNA, 58 bp, Homo sapiens
tccaaaagagggatgtaaagttcacgtggtcttcagcacagagcgctacaacccagag

SEQ ID NO: 1059 - DNA, 66 bp, Homo sapiens
gcgcgcggcgcttcacttcttcaacttccggtccggctcgcccagcgcgctacgagtgctggccga

SEQ ID NO: 1060 - DNA, 26 bp, Homo sapiens
cctcaggatgctggggtcccgcgcag

SEQ ID NO: 1061 - DNA, 98 bp, Homo sapiens
cgccggcaacggctgcctgctccctggtccgggcccaggggcccgcgccccaccgccccgctgctcgcgctgctgctgttgctcgccccggtggcggc

SEQ ID NO: 1062 - DNA, 145 bp, Homo sapiens
ctcataaggtgctatctgttcagtgatgccctcagagctcttgctgttagctggcagctgacgctgctaggatagttagtttggaaatggtacttcataataaactacacaaggaaagtcagccactgtgtcttatgaggaattg

SEQ ID NO: 1063 - DNA, 115 bp, Homo sapiens
gccttaaccagtctctcaagtgatgagacagtgaagtaaaattgagtgcactaaacaaataagattctgaggaagtcttatcttctgcagtgagtatggcccgatgctttctgtg

SEQ ID NO: 1064 - DNA, 1238 bp, Homo sapiens
agctttgggtgcctttgccacaagacctagcctaatttaccaaggatgaattctttcaattcttcatgcgtgcccttttcatatacttattttattttttaccataatcttatagcacttgcatcgttattaagcccttatttgttttgtgtttcattggtctctatctcctgaatctaacacatttcatagcctacattttagtttctaaagccaagaagaatttattacaaatcagaactttggaggcaaatctttctgcatgaccaaagtgataaattcctgttgaccttcccacacaatccctgtactctgacccatagcactcttgtttgctttgaaaatatttgtccaattgagtagctgcatgctgttcccccaggtgttgtaacacaactttattgattgaatttttaagctacttattcatagttttatatccccctaaactacctttttgttccccattccttaattgtattgttttcccaagtgtaattatcatgcgttttatatcttcctaataaggtgtggtctgtttgtctgaacaaagtgctagactttctggagtgataatctggtgacaaatattctctctgtagctgtaagcaagtcacttaatctttctacctcttttttctatctgccaaattgagataatgatacttaaccagttagaagaggtagtgtgaatattaattagtttatattactctcattctttgaacatgaactatgcctatgtagtgtctttatttgctcagctggctgagacactgaagaagtcactgaacaaaacctacacacgtaccttcatgtgattcactgccttcctctctctaccagtctatttccactgaacaaaacctacacacataccttcatgtggttcagtgccttcctctctctaccagtctatttccactgaacaaaacctacgcacataccttcatgtggctcagtgccttcctctctctaccagtctatttccattctttcagctgtgtctgacatgtttgtgctctgttccattttaacaactgctcttacttttccagtctgtacagaatgctatttcacttgagcaagatgatgtaatggaaagggtgttggcattggtgtctggagacctggatttgagtcttggtgctatcaatcaccgtctgtgtttgagcaaggcatttggctgctgtaagcttattgcttcatctgtaagcggtggtttgtaattcctgatc

SEQ ID NO: 1065 - DNA, 212 bp, Homo sapiens
cgaaaatggacattgagatactatcattaacattaggaccttagaattttgggtattgtaatctgaagtatggtattacaaaacaaacaaacaaacaaaaaacccatgtgttaaaatactcagtgctaaacatggcttaatcttattttatcttctttcctcaatataggagggaagatttttccatttgtattactgcttcccattgagta

SEQ ID NO: 1066 - DNA, 56 bp, Homo sapiens
tcttacccaacaccaaggccctatccaaaacctgcaccttccagcgggaaagacta

SEQ ID NO: 1067 - DNA, 64 bp, Homo sapiens
gttgccacagcatggtatggcaatagaatcgttcaagaattctatgaccctatgaccccagtca

SEQ ID NO: 1068 - DNA, 129 bp, Homo sapiens
ttggcatcctcctgggagtgatagcaatctttgtggccaccgttggcatgaagtgtatgaagtgcttggaagacgatgaggtgcagaagatgaggatggctgtcattgggggtgcgatatttcttcttg

SEQ ID NO: 1069 - DNA, 26 bp, Homo sapiens
gcacattgcaagcaacccgtgccttg

SEQ ID NO: 1070 - DNA, 198 bp, Homo sapiens
ttgggcttcattctcgccttcctgggatggatcggcgccatcgtcagcactgccctgccccagtggaggatttactcctatgccggcgacaacatcgtgaccgcccaggccatgtacgaggggctgtggatgtcctgcgtgtcgcagagcaccgggcagatccagtgcaaagtctttgactccttgctgaatctgagc

SEQ ID NO: 1071 - DNA, 188 bp, Homo sapiens
tgcgtctcagttcccgagcctgggagcaaccgcagcttctagtatccagactccagcgccgccccgggcgcggaccccaaccccgacccagagcttctccagcggcggcgcagcgagcagggctccccgccttaacttcctccgcggggcccagccaccttcgggagtccgggttgcccacctgcaaa

SEQ ID NO: 1072 - DNA, 411 bp, Homo sapiens
tcctcttggtctgtgagcatccagccttacttttgtatccaatcatatttccatacttcgctgaactgtgtttatggatagtttccaccagatctttggatcttcatcttgaaggctgccgtgccacataagctatgatcaaatacatctgttatgctcttctcctattcatctgccttctgcccgttgattttcagcaaactcccagaggatgaaggggagttttctgtttggccccacaggggaggagcgagcgagattgacgtggaagctgggcctctgaaggacacagagtgctctaagaaagggacgatggggcagatccatgttcacaaacacgcccatgtgaattcactctcagatgtctcctcgtgtcagcacgctgggtgccagcacgctctgatattgaca

SEQ ID NO: 1073 - DNA, 128 bp, Homo sapiens
caaggatgccgtggataaattgctcaaggacctggatgccaatggagatgcccaggtggacttcagtgagttcatagtgttcgtggctgcaatcacgtctgcctgtcacaagtactttgagaaggcag

SEQ ID NO: 1074 - DNA, 77 bp, Homo sapiens
catggtcccaggcttcccaaaagtgtttgttggcaattattcccctaggctgagcctgctcatgtacctctgattaa

SEQ ID NO: 1075 - DNA, 28 bp, Homo sapiens
cacagccgccagacccgcctgctgagcc

SEQ ID NO: 1076 - DNA, 33 bp, Homo sapiens
aatgggcggaaagcttgcctcaatcctgcatcc

SEQ ID NO: 1077 - DNA, 114 bp, Homo sapiens
ctcactggtggctgttcctgaaggaggccctgcccttataggaacagaagaggaaagagagacacagctgcagaggccacctggattgtgcctaatgtgtttgagcatcgctta

SEQ ID NO: 1078 - DNA, 437 bp, Homo sapiens
gattaactctacctgcacactgtcctattatattcattctttttgaaatgtcaaccccaagttagttcaatctggattcatatttaatttgaaggtagaatgttttcaaatgttctccagtcattatgttaatatttctgaggagcctgcaacatgccagccactgtgatagaggctggcggatccaagcaaatggccaatgagatcattgtgaaggcaggggaatgtatgtgcacatctgttttgtaactgtttagatgaatgtcagttgttatttattgaaatgatttcacagtgtgtggtcaacatttctcatgttgaaactttaagaactaaaatgttctaaatatcccttggacattttatgtctttcttgtaaggcatactgccttgtttaatggtagttttacagtgtttctggcttagaacaaaggggc

SEQ ID NO: 1079 - DNA, 436 bp, Homo sapiens
gagggtgacacaccatgctcacggcccctggagaccgtcgtgctggcgagccgtgctccgtagctccccggtccgcctcggcagcggtcagagtcgcctacaggagttgagccgcccgcgccagaaggttttggcgaagctcttggagaggcgtcgagcacagtagggcggcgggggtgcgttgagcgctcgggggtcaggcagtcggccgggatcgccgctggggagcgtttccgaggcgaggaggaggaggaggagatgctgctcctcttctccccctccccaggctccttctacagctccttcagcccacgcccgcagccgcttgtgggagaagtggtggtggctctcggcgcccgcggcggctgccggcggcccgccccgacgccgcgtccctgcagccctcgcccggcgctccagtagcaggacccggtct

SEQ ID NO: 1080 - DNA, 109 bp, Homo sapiens
atgcacgtgtcactagctgaggccctggaggttcggggtggaccacttcaggaggaagaaatatgggctgtattaaatcaaagtgctgaaagtctccaagaattattca

SEQ ID NO: 1081 - DNA, 29 bp, Homo sapiens
tgctgttgctgccatctggtagtgtgtca

SEQ ID NO: 1082 - DNA, 70 bp, Homo sapiens
ttccaatcaggatcttcgagcattcactgcaccagaggttcttcaaaatcagtcactaacttctctctca

SEQ ID NO: 1083 - DNA, 120 bp, Homo sapiens
ggagatcatctcaacagcatactgcttggaatgtgtgaggatgttatttacgctcgagtttctgttcggactgtgctggatgcttgcagtgcccacattaggaatagcaattgtgcaccc

SEQ ID NO: 1084 - DNA, 25 bp, Homo sapiens
aaactggttctgggaaatctttctg

SEQ ID NO: 1085 - DNA, 440 bp, Homo sapiens
tgctacctagtgtatccagggaatccatgcttgtatccctgccagatttccccaagacctggactcttctagtttttctcttgttttggatatgaagaatcccaagaataaccaatgctatatattacctgaaagtcccacctctgttctgcatttctaaggctgtattttatcttgtttgccctatctgatctggatctatactttatctgctcttatccttagggttgtagtcctggagtgttggtccctcttccttgcacaggttacaaatttaccactgccacacagtgttcttgttgacttcctcagaattcctcatcggtaggggtttagttcccatcttaaccaggatgtcagatggctgccaggaatgtattcaaattctgcacagtttttcagttgataacaaacaggcccacagatcttctagacaaatg

SEQ ID NO: 1086 - DNA, 83 bp, Homo sapiens
cagatcagctttcctgtaacagtgaacaaaagcctgatcgaagccaggctattcgagatcgattgcgaggaaaaggattacca

SEQ ID NO: 1087 - DNA, 68 bp, Homo sapiens
aagctctacttctgatgtactagacatacaaaagcctccactctctcatcagacctttcttaacaaag

SEQ ID NO: 1088 - DNA, 251 bp, Homo sapiens
gcttcatccatggacttgctttgtacagctgacagagacttctcttcaggagagactgccacatatcgtcgttgtcaccctgaggcagtaacagtgcggacttcaactactcctagaaaaaaggaggcaagatactcagatggaagtatagccttggatatctttggccctcagaaaatggatccaatatatcacactcgagaattgcccacctcctcagcaatatcaagtgctttggaccgaatccgaga

SEQ ID NO: 1089 - DNA, 54 bp, Homo sapiens
tgaatccagcagtggtctcccaggggtagatgaaaccttaagtcaaggccagtc

SEQ ID NO: 1090 - DNA, 105 bp, Homo sapiens
gccaaaatggcccttagacagtctcggttgagcctatatccaggagacacaatcaaagcgtccatgcttgacatcaccagggatccgttaagagaaattgcccta

SEQ ID NO: 1091 - DNA, 138 bp, Homo sapiens
ggaagaatgaggataaccgaaggaaagtaaacataatgcttctgaacgggcaaagactggaactgacctgtgataccaaaactatatgtaaagatgtgtttgatatggttgtggcacatattggcttagtagagcatc

SEQ ID NO: 1092 - DNA, 48 bp, Homo sapiens
gttcatggtgtgtcttactttagaatggagcactatttgcccgccaga

SEQ ID NO: 1093 - DNA, 72 bp, Homo sapiens
gaaacttgatttatcctatatcaaagaagagttacccaaattgcataatacctatgtgggagcttctgaaaa

SEQ ID NO: 1094 - DNA, 124 bp, Homo sapiens
accgagtgcaccctgagaagaagtcacaaacaggaatattgcttggagtctgttctaaaggtgtccttgtgtttgaagttcacaatggagtgcgcacattggtccttcgctttccatggaggga

SEQ ID NO: 1095 - DNA, 79 bp, Homo sapiens
acattgcaaaatacatcagatggaataaaacatggcttccagacagacaacagtaagatatgccagtacctgctgcacc

SEQ ID NO: 1096 - DNA, 48 bp, Homo sapiens
cataagttccagctacagatgagagcaagacagagcaaccaagatgcc

SEQ ID NO: 1097 - DNA, 346 bp, Homo sapiens
agagcttcgtttaggagcctgaatctccaagcagagtctgttagaggatttaatatgggacgagcaatcagcactggcagtctggccagcagcaccctcaacaaacttgctgttcgacctttatcagttcaagctgagattctgaagaggctatcctgctcagagctgtcgctttaccagccattgcaaaacagttcaaaagagaagaatgacaaagcttcatgggaggaaaagcctagagagatgagtaaatcataccatgatctcagtcaggcctctctctatccacatcggaaaaatgtcattgttaacatggaacccccaccacaaaccgttgcagagttgg

SEQ ID NO: 1098 - DNA, 85 bp, Homo sapiens
gttgcgagtttaaatagaagtcctgaaaggaggaaacatgaatcagactcctcatccattgaagaccctgggcaagcatatgttc

SEQ ID NO: 1099 - DNA, 29 bp, Homo sapiens
gaatgactatgcatagttctggaaactct

SEQ ID NO: 1100 - DNA, 29 bp, Homo sapiens
tcttcaccagaaagggagatcaccttagt

SEQ ID NO: 1101 - DNA, 26 bp, Homo sapiens
gatttcaaattattggtggggagaag

SEQ ID NO: 1102 - DNA, 50 bp, Homo sapiens
tatttatcagttcagttgcccctggaggaccagctgacttggatggatgc

SEQ ID NO: 1103 - DNA, 71 bp, Homo sapiens
gccaccatgctgcaattgaaattttgcaaaatgcacctgaagatgtgacacttgttatctctcagccaaaa

SEQ ID NO: 1104 - DNA, 95 bp, Homo sapiens
tcttcctacatgcaagacagtgctatagattcttcttccaaggatcaccactggtcacgtggtaccctgaggcacatctcggagaactcctttgg

SEQ ID NO: 1105 - DNA, 109 bp, Homo sapiens
tgccagccatttaggtgaccaaacctggcaggaatcacagcatggcagcccttccccatctgtaatatccaaagccaccgagaaagagactttcactgatagtaaccaa

SEQ ID NO: 1106 - DNA, 27 bp, Homo sapiens
tcctcttcagtgaatacatccaacaag

SEQ ID NO: 1107 - DNA, 25 bp, Homo sapiens
aactttttcttcatcacctcctaag

SEQ ID NO: 1108 - DNA, 63 bp, Homo sapiens
cctggagatatctttgaggttgaactggctaaaaatgataacagcttggggataagtgtcacg

SEQ ID NO: 1109 - DNA, 90 bp, Homo sapiens
ggaggtgtgaatacgagtgtcagacatggtggcatttatgtgaaagctgttattccccagggagcagcagagtctgatggtagaattcac

SEQ ID NO: 1110 - DNA, 83 bp, Homo sapiens
gtgatcgcgtcctagctgtcaatggagttagtctagaaggagccacccataagcaagctgtggaaacactgagaaatacagga

SEQ ID NO: 1111 - DNA, 53 bp, Homo sapiens
ctgttattagaaaagggacaatctccaacatctaaagaacatgtcccggtaac

SEQ ID NO: 1112 - DNA, 25 bp, Homo sapiens
tgtaccctttcagatcagaatgccc

SEQ ID NO: 1113 - DNA, 73 bp, Homo sapiens
ggattcagtttttctcgagaagataatcttataccggagcaaattaatgccagcatagtaagggttaaaaagc

SEQ ID NO: 1114 - DNA, 74 bp, Homo sapiens
ttcagtctccagcacaagtacttccaaacagcagtaaagactcttctcagccatcatgtgtggagcaaagcacc

SEQ ID NO: 1115 - DNA, 41 bp, Homo sapiens
gcaaaaaacagtgcaagtccccatccagaagagacagttac

SEQ ID NO: 1116 - DNA, 135 bp, Homo sapiens
gtgacagctccagcaaacatatcaaattcgacctggagttcagctttgcatcagactctaagcaacatggtatcacaggcacagagtcatcatgaagcacccaagagtcaagaagataccatttgtaccatgttt

SEQ ID NO: 1117 - DNA, 34 bp, Homo sapiens
ttcccctctaccaccggatatggctcctgggcag

SEQ ID NO: 1118 - DNA, 74 bp, Homo sapiens
atcagaatctgcttcctctagttcgatggataagtatcatatacatcacatttctgaaccaactagacaagaaa

SEQ ID NO: 1119 - DNA, 108 bp, Homo sapiens
ctcctcattaccctaattaaatcagaaaaaggaagcctgggttttacagtaaccaaaggcaatcagagaattggttgttatgttcatgatgtcatacaggatccagcc

SEQ ID NO: 1120 - DNA, 138 bp, Homo sapiens
gatacagatgttactaatatgactcatacagatgcagttaatctgctccgggctgcatccaaaacagtcagattagttattggacgagttctagaattacccagaataccaatgttgcctcatttgctaccggacata

SEQ ID NO: 1121 - DNA, 43 bp, Homo sapiens
tccttatgtggaggtcatgacagcctttatcaagtggtatata

SEQ ID NO: 1122 - DNA, 131 bp, Homo sapiens
aatccaaggtccgtcgcagccattgagggtaatctccagctattagatgtcatccattatgtgaacggagtcagcacacaaggaatgaccttggaggaagttaacagagcattagacatgtcacttccttc

SEQ ID NO: 1123 - DNA, 42 bp, Homo sapiens
aagaggtctgctgtttcagctccaaagtcaaccaaaggcaat

SEQ ID NO: 1124 - DNA, 35 bp, Homo sapiens
gttcctacagtgtggggtcttgcagccagcctgcc

SEQ ID NO: 1125 - DNA, 73 bp, Homo sapiens
ataaatgaaatatcgtaccccaaaggaaaatgttctacttatcagataaagggatcaccaaacttgactctgc

SEQ ID NO: 1126 - DNA, 76 bp, Homo sapiens
caagaagctgaagttatccagtctctgctggatgttgtggatgaggaagcccagaatcttttaaacgaaaataatg

SEQ ID NO: 1127 - DNA, 33 bp, Homo sapiens
aagatgaatgggaagttatcagaagagagaaca

SEQ ID NO: 1128 - DNA, 31 bp, Homo sapiens
aagatacagactgcgatggttcacctttacc

SEQ ID NO: 1129 - DNA, 32 bp, Homo sapiens
tggctgtgaagaatattgtgaagaaaaagtaa

SEQ ID NO: 1130 - DNA, 66 bp, Homo sapiens
atgatgatgaaataacatggggaaatgatgagttgccaatagagagaacaaaccatgaagattctg

SEQ ID NO: 1131 - DNA, 119 bp, Homo sapiens
cctttctgacaaacgatgagctcgctgtactccctgtcgtcaaagtgcttccctctggtaaatacacgggtgccaacttaaaatcagtcattcgagtcctgcggggtttgctagatcaa

SEQ ID NO: 1132 - DNA, 44 bp, Homo sapiens
aattaaaacctttggatcagtgtctaattgggcaaactaaggaa

SEQ ID NO: 1133 - DNA, 209 bp, Homo sapiens
gagttcgtttacattgcctgccaaggaccactgcctacaactgttggagacttctggcagatgatttgggagcaaaaatccacagtgatagccatgatgactcaagaagtagaaggagaaaaaatcaaatgccagcgctattggcccaacatcctaggcaaaacaacaatggtcagcaacagacttcgactggctcttgtgagaatgca

SEQ ID NO: 1134 - DNA, 172 bp, Homo sapiens
tggccagaccatgatacaccttctcaaccagatgatctgcttacttttatctcctacatgagacacatccacagatcaggcccaatcattacgcactgcagtgctggcattggacgttcagggaccctgatttgcatagatgtggttctgggattaatcagtcaggatcttg

SEQ ID NO: 1135 - DNA, 57 bp, Homo sapiens
catctctgatttggtgcgctgcatgagactacaaagacacggaatggttcagacaga

SEQ ID NO: 1136 - DNA, 56 bp, Homo sapiens
tatattttctgctatcaagtcatcctttatgtcctgacacgtcttcaagcagaaga

SEQ ID NO: 1137 - DNA, 326 bp, Homo sapiens
cttagggatgattaaaggcagcatttgatgatagcagacattgttacaaggacatggtgagtctatttttaatgcaccaatcttgtttatagcaaaaatgttttccaatattttaataaagtagttattttataggggatacttgaaaccagtatttaagctttaaatgacagtaatattggcatagaaaaaagtagcaaatgtttactgtatcaatttctaatgtttactatatagaatttcctgtaatatatttatatactttttcatgaaaatggagttatcagttatctgtttgttactgcatcatctgtttgtaatcatta

SEQ ID NO: 1138 - DNA, 104 bp, Homo sapiens
taaattctgggagggcttggttgtcagcagcagcaggaggaggcagagcacagcatcgtcgggaccagactcgtctcaggccagttgcagccttctcagccaaa

SEQ ID NO: 1139 - DNA, 32 bp, Homo sapiens
tgagaattgcagtgatttgcttttgcctccta

SEQ ID NO: 1140 - DNA, 25 bp, Homo sapiens
gttaaacaggctgattctggaagtt

SEQ ID NO: 1141 - DNA, 149 bp, Homo sapiens
ccacaacagatgaaactgtgccagccaaacaacaaatgggcattgtccccagaagcttggacaaaaaggcacacagagttcaattccagttgaacagaataaaggccaaaatagagctgccttgggggtcactgcaattagactgctta

SEQ ID NO: 1142 - DNA, 32 bp, Homo sapiens
catctcagaagcagaatctcctagccccacag

SEQ ID NO: 1143 - DNA, 32 bp, Homo sapiens
aacttctcataattaaactacagtgatgaaag

SEQ ID NO: 1144 - DNA, 42 bp, Homo sapiens
aatgctgtgtcctctgaagaaaccaatgactttaaacaagag

SEQ ID NO: 1145 - DNA, 37 bp, Homo sapiens
ttccaagtaagtccaacgaaagccatgaccacatgga

SEQ ID NO: 1146 - DNA, 43 bp, Homo sapiens
gactccattgactcgaacgactctgatgatgtagatgacactg

SEQ ID NO: 1147 - DNA, 186 bp, Homo sapiens
ctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgaca

SEQ ID NO: 1148 - DNA, 273 bp, Homo sapiens
tgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagacc

SEQ ID NO: 1149 - DNA, 200 bp, Homo sapiens
tctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttca

SEQ ID NO: 1150 - DNA, 56 bp, Homo sapiens
tttggtggtgtcaattgcttatttgttttcccacggttgtccagcaattaataaaa

SEQ ID NO: 1151 - DNA, 25 bp, Homo sapiens
ttaaaggtgaatccttgtttcattc

SEQ ID NO: 1152 - DNA, 28 bp, Homo sapiens
atctggatcctggtcaaactttaattta

SEQ ID NO: 1153 - DNA, 202 bp, Homo sapiens
atgtcatgtcgtaagtccctctgtatactttaaagctctctacagtccccccaaaatatgaacttttgtgcttagtgagtgcaacgaaatatttaaacaagttttgtattttttgcttttgtgttttggaatttgccttatttttcttggatgcgatgttcagaggctgtttcctgcagcatgtatttccatggcccacaca

SEQ ID NO: 1154 - DNA, 450 bp, Homo sapiens
tgagtgcactcaattggaccatgaattttcctgtgtctttgctggcaatccaacctcatgcctaaagctcaaggatgagagagtctattggaaacaagttgcccggaatctgcgctcacagaaagacatctgtagatattccaagacagctgtgaaaaccagagtgtgcagaaaggattttccagaatccagtcttaagctagtcagctccactctatttgggaacacaaagcccaggaaggagaaaacagagatgtcccccagggagcacatcaaaggcaaagagaccaccccctctagcctagcagtgacccagaccatggccaccaaagctcccgagtgtgtggaggacccagatatggcaaaccagaggaagactgccctggagttctgtggagagacttggagctctctctgcacattcttcctcagcatagtgcaggacacgtc

SEQ ID NO: 1155 - DNA, 114 bp, Homo sapiens
atgaagatctgtagcctcaccctgctctccttcctcctactggctgctcaggtgctcctggtggaggggaaaaaaaaagtgaagaatggacttcacagcaaagtggtctcagaa

SEQ ID NO: 1156 - DNA, 162 bp, Homo sapiens
gaggagctgtgagtaacgtgccacagtgttgtaaaaacccagtgagtgttataaaaacccagtcagcctggctcctgttgaatagtctaccccccttgcactctacctgacacagctgcagcctgcaattcactcgcactgcctgggattgcactggatccg

SEQ ID NO: 1157 - DNA, 34 bp, Homo sapiens
agagcggatgtgatgagggaaaaggagaactcag

SEQ ID NO: 1158 - DNA, 107 bp, Homo sapiens
tctcttgaatgtacccttcaactgttgaatgtttaatagtaaatcttatatgtccttatttactttttagctttctctcaaataaagtgtaacactagttgagataa

SEQ ID NO: 1159 - DNA, 1586 bp, Homo sapiens
agccctaggcttccacgtactgcagcctccagagagtatctgaggcacatgtcagcaagtcctaagcctgttagcatgctggtgagccaagcagtttgaaattgagctggacctcaccaagctgctgtggccatcaacctctgtatttgaatcagcctacaggcctcacacacaatgtgtctgagagattcatgctgattgttattgggtatcaccactggagatcaccagtgtgtggctttcagagcctcctttctggctttggaagccatgtgattccatcttgcccgctcaggctgaccactttatttctttttgttcccctttgcttcattcaagtcagctcttctccatcctaccacaatgcagtgcctttcttctctccagtgcacctgtcatatgctctgatttatctgagtcaactcctttctcatcttgtccccaacaccccacagaagtgctttcttctcccaattcatcctcactcagtccagcttagttcaagtcctgcctcttaaataaacctttttggacacacaaattatcttaaaactcctgtttcacttggttcagtaccacatgggtgaacactcaatggttaactaattcttgggtgtttatcctatctctccaaccagattgtcagctccttgagggcaagagccacagtatatttccctgtttcttccacagtgcctaataatactgtggaactaggttttaataattttttaattgatgttgttatgggcaggatggcaaccagaccattgtctcagagcaggtgctggctctttcctggctactccatgttggctagcctctggtaacctcttacttattatcttcaggacactcactacagggaccagggatgatgcaacatccttgtctttttatgacaggatgtttgctcagcttctccaacaataagaagcacgtggtaaaacacttgcggatattctggactgtttttaaaaaatatacagtttaccgaaaatcatataatcttacaatgaaaaggactttatagatcagccagtgaccaaccttttcccaaccatacaaaaattccttttcccgaaggaaaagggctttctcaataagcctcagctttctaagatctaacaagatagccaccgagatccttatcgaaactcattttaggcaaatatgagttttattgtccgtttacttgtttcagagtttgtattgtgattatcaattaccacaccatctcccatgaagaaagggaacggtgaagtactaagcgctagaggaagcagccaagtcggttagtggaagcatgattggtgcccagttagcctctgcaggatgtggaaacctccttccaggggaggttcagtgaattgtgtaggagaggttgtctgtggccagaatttaaacctatactcactttcccaaattgaatcactgctcacactgctgatgatttagagtgctgtccggtggagatcccacccgaacgtcttatctaatcatgaaactccctagttccttcatgtaacttccctgaaaaatctaagtgtttcataaatttgagagtctgtgacccacttaccttg

SEQ ID NO: 1160 - DNA, 52 bp, Homo sapiens
aagttctgaaagttcgaaaatctcaacgttctcgtcaaaagaagactacata

SEQ ID NO: 1161 - DNA, 49 bp, Homo sapiens
ctgaagaatggagttcaaacatgtctaaacccagattcagcagatgtga

SEQ ID NO: 1162 - DNA, 106 bp, Homo sapiens
agaaagggtcgctgttcctgcatcagcaccaaccaagggactatccacctacaatccttgaaagaccttaaacaatttgccccaagcccttcctgcgagaaaattg

SEQ ID NO: 1163 - DNA, 41 bp, Homo sapiens
cctcttgggcatcatcttgctggttctgattggagtgcaag

SEQ ID NO: 1164 - DNA, 458 bp, Homo sapiens
ttccaaggatggaccacacagaggctgcctctcccatcacttccctacatggagtatatgtcaagccataattgttcttagtttgcagttacactaaaaggtgaccaatgatggtcaccaaatcagctgctactactcctgtaggaaggttaatgttcatcatcctaagctattcagtaataactctaccctggcactataatgtaagctctactgaggtgctatgttcttagtggatgttctgaccctgcttcaaatatttccctcacctttcccatcttccaagggtactaaggaatctttctgctttggggtttatcagaattctcagaatctcaaataactaaaaggtatgcaatcaaatctgctttttaaagaatgctctttacttcatggacttccactgccatcctcccaaggggcccaaattctttcagtggctacctacatacaattcc

SEQ ID NO: 1165 - DNA, 63 bp, Homo sapiens
aagagatgtctgaatccagaatcgaaggccatcaagaatttactgaaagcagttagcaaggaa

SEQ ID NO: 1166 - DNA, 44 bp, Homo sapiens
aacttgaaattattcctgcaagccaattttgtccacgtgttgag

SEQ ID NO: 1167 - DNA, 47 bp, Homo sapiens
tacctgcatcagcattagtaatcaacctgttaatccaaggtctttag

SEQ ID NO: 1168 - DNA, 50 bp, Homo sapiens
tgccattctgatttgctgccttatctttctgactctaagtggcattcaag

SEQ ID NO: 1169 - DNA, 52 bp, Homo sapiens
attgcttagacatattctgagcctacagcagaggaacctccagtctcagcac

SEQ ID NO: 1170 - DNA, 325 bp, Homo sapiens
cagctgtgatacttgtagatttatatttagcaaaatgttagcatgtatgacaagacaatgagagtaattgcttgacaacaacctatgcaccaggtatttaacattaactttggaaacaaaaatgtacaattaagtaaagtcaacatatgcaaaatactgtacattgtgaacagaagtttaattcatagtaatttcactctctgcattgacttatgagataattaatgattaaactattaatgataaaaataatgcatttgtattgttcataatatcatgtgcacttcaagaaaatggaatgctactcttttgtggtttacgtgta

SEQ ID NO: 1171 - DNA, 88 bp, Homo sapiens
tgctcctctgcgagcatctctggtgcccatggaacactgcataacccgtttctttgaggagtgtgaccccaacaaggataagcacatc

SEQ ID NO: 1172 - DNA, 95 bp, Homo sapiens
tgatcttctcttaagggactttaagaaaaactaccacatgtatgtgtatcctgtgcactggcagtttagtgaacttgaccaacaccctatggata

SEQ ID NO: 1173 - DNA, 118 bp, Homo sapiens
cctacttgtacggactttgaagtgattcagtttcctctacggatgagagactggctcaagaatatcctcatgcagctttatgaagccaactctgaacacgctggttatctaaatgaga

SEQ ID NO: 1174 - DNA, 115 bp, Homo sapiens
tgtggcactgacaatcagacctatgctagttcctgtcatctattcgctactaaatgcagactggaggggaccaaaaaggggcatcaactccagctggattattttggagcctgca

SEQ ID NO: 1175 - DNA, 102 bp, Homo sapiens
tcttgcatgagcttccagtgtaaaagaggccacatctgtaaggcagaccaacagggaaaacctcactgtgtctgccaggatccagtgacttgtcctccaaca

SEQ ID NO: 1176 - DNA, 61 bp, Homo sapiens
agcagagaactcatcaaatgaggaggaaacgtcaagtgaaggcaacatgagggtgcatgct

SEQ ID NO: 1177 - DNA, 145 bp, Homo sapiens
ccacgcccagaaatcatggagttgatgatgatggcgatgatgatggcgatgatggcggcactgatggccccaggcacagtgcaagtgatgactacttcatcccaagccaggcctttctggaggccgagagagctcaatccattgc

SEQ ID NO: 1178 - DNA, 76 bp, Homo sapiens
gaagctatcagcaaccacaaagagacagaagaaaagactgtttctgaggctctgctcatggaacctactgatgatg

SEQ ID NO: 1179 - DNA, 323 bp, Homo sapiens
tagccaaggcctaagggatcaaggaaaccaagagcaggatccaaatatttccaatggagaagaggaagaagaaaaagagccaggtgaagttggtacccacaatgataaccaagaaagaaagacagaattgcccagggagcatgctaacagcaagcaggaggaagacaatacccaatctgatgatattttggaagagtctgatcaaccaactcaagtaagcaagatgcaggaggatgaatttgatcagggtaaccaagaacaagaagataactccaatgcagaaatggaagaggaaaatgcatcgaacgtcaataagcacattc

SEQ ID NO: 1180 - DNA, 113 bp, Homo sapiens
tggagtatgcaccaactgaaggtacattggacataaaagaagatatgagtgagcctcaggagaaaaaactctcagagaacactgattttttggctcctggtgttagttccttc

SEQ ID NO: 1181 - DNA, 112 bp, Homo sapiens
tcatcagtactaaagtcaaaagaggaaagccatgaacagtcagcagaacagggcaagagttctagccaagagctgggattgaaggatcaagaggacagtgatggtcacttaa

SEQ ID NO: 1182 - DNA, 32 bp, Homo sapiens
cagtatccacagaagacgattcccaccataag

SEQ ID NO: 1183 - DNA, 54 bp, Homo sapiens
caactgctgaaacggtagcacctgacaacactgcaatccccagtttaagggctg

SEQ ID NO: 1184 - DNA, 27 bp, Homo sapiens
caagattattatctgatcattccaaac

SEQ ID NO: 1185 - DNA, 26 bp, Homo sapiens
cctatgtctcttgggaactgcagctg

SEQ ID NO: 1186 - DNA, 27 bp, Homo sapiens
tggctctgggtccagccccttacttaa

SEQ ID NO: 1187 - DNA, 117 bp, Homo sapiens
ttcccttttggtttgcaagcactgcctgtaaagccctcgcatgagaggccagcctgctagggaaatccaggaatctgcaacaaaaacgatgacagtctgaaatactctctggtgcca

SEQ ID NO: 1188 - DNA, 27 bp, Homo sapiens
attgacttgagtactttaagccttgtt

SEQ ID NO: 1189 - DNA, 175 bp, Homo sapiens
taggtgcaactgtgacttgggtctggttggttgttgtttgttgttttgagtcagctgattttcacttcccactgaggttgtcataacatgcaaattgcttcaattttctctgtggcccaaacttgtgggtcacaaaccctgttgagataaagctggctgttatctcaacatcttc

SEQ ID NO: 1190 - DNA, 192 bp, Homo sapiens
gctgaccatttctgctccgggatctcagctcccgttccccaagcacactcctagctgctccagtctcagcctgggcagcttccccctgccttttgcacgtttgcatccccagcatttcctgagttataaggccacaggagtggatagctgttttcacctaaaggaaaagcccacccgaatcttgtagaaata

SEQ ID NO: 1191 - DNA, 82 bp, Homo sapiens
tgatcacctcggtgaagcggtggcagaaggggcagagagagttcaagcgcatctcccgcagcatccgcaagctgcagtgcta

SEQ ID NO: 1192 - DNA, 184 bp, Homo sapiens
aggagataacctacatcaaccgagataccaaaatcatcctggagaccaagagcaagaccatttacaagctgaacggtgtgtccgaaagggacctgaagaaatcggtgctgtggctcaaagacagcttgcagtgcacctgtgaggagatgaacgacatcaacgcgccctatctggtcatgggaca

SEQ ID NO: 1193 - DNA, 34 bp, Homo sapiens
tgatgacaacgacataatggaaacgctttgtaaa

SEQ ID NO: 1194 - DNA, 291 bp, Homo sapiens
ctgtgccacggcatcgaataccagaacatgcggctgcccaacctgctgggccacgagaccatgaaggaggtgctggagcaggccggcgcttggatcccgctggtcatgaagcagtgccacccggacaccaagaagttcctgtgctcgctcttcgcccccgtctgcctcgatgacctagacgagaccatccagccatgccactcgctctgcgtgcaggtgaaggaccgctgcgccccggtcatgtccgccttcggcttcccctggcccgacatgcttgagtgcgaccgtttc

SEQ ID NO: 1195 - DNA, 34 bp, Homo sapiens
tgctgcagggccctggctcgctgctgctgctctt

SEQ ID NO: 1196 - DNA, 36 bp, Homo sapiens
agcgggcccgggacaagctcgaactccggccgcctc

SEQ ID NO: 1197 - DNA, 100 bp, Homo sapiens
agctgcgcgcgggcttgcagcgcctcgcccgcgctgtcctcccggtgtcccgcttctccgcgccccagccgccggctgccagcttttcggggccccgagt

SEQ ID NO: 1198 - DNA, 38 bp, Homo sapiens
tctctggtgtatactgattgagaaaataattaaactga

SEQ ID NO: 1199 - DNA, 435 bp, Homo sapiens
atacacctgctttgggtaaaactctttgcaagcagtaattaacactagtaacagtgaaagcacaagatttccaaatcagtcgttttctcaaaaaaatatcgtataagtgactcatcctgtctgctaactccagacctcccagcttgaagccaaatctttccatgtgagattgatatggatttcctagaagtactggaatgttgtcatatcttgccctattttaattctgctatagaaaacaattgccttcacttttaaggagtaatttgaatattaataactctggtctagattttcatataatgtattaaagacaaagtagtgaacatcaatgaacatctgatagagataaactgtaatcaggcataagcttgtttgtatgttctggcagtgactaatcagtaaatgatgtcggtttgcccagtatcacttatc

SEQ ID NO: 1200 - DNA, 32 bp, Homo sapiens
ttacttagtcttctatgtatagctatcaagga

SEQ ID NO: 1201 - DNA, 527 bp, Homo sapiens
tgcacttggtgataaacgttttctaaatttttagttaagtatatggataaaaagttatgaactattaaaaatgtgatgtggaccaaaggctaggttgtaatcttgatagtctaaaaaatgatcaaaacaaatgattttcaaggaatattcaatattctgcctttcagaaagtgtatttatatctgtgcttcataaatattaatgttcttcagaacatcattttaaaggagatacttgaattgttatttaaatcaaaccagatgtaaaacactcacatacaagttcatactttaaaagaggaaagctacttaacaatgacaaatatttcacaataataatttttacttatataccatctttcaactgaacatttcagttcttccaagagcttcttagagtagtatattttgggggcagtcaaggaataaactacagtgtaaacatatcccagatgaaaactgctgtatggaaaaatgacagaaagtaactgattgacactgttgattcacagttcagcctcctatctg

SEQ ID NO: 1202 - DNA, 113 bp, Homo sapiens
tgccaatggattgataacactcattgaagatgatgctttaaatggtgctattatgaagatcacaacttctaagggaattcattttcaagactatgatacaactccatttcaag

SEQ ID NO: 1203 - DNA, 125 bp, Homo sapiens
tcttatgaacagtggtgtgagactgaatgccatttgtccaggctttgttaacacagccatccttgaatcaattgaaaaagaagaaaacatgggacaatatatagaatataaggatcatatcaagg

SEQ ID NO: 1204 - DNA, 41 bp, Homo sapiens
atgcccgttgcacagcagccggtttattgtgcttcaaagca

SEQ ID NO: 1205 - DNA, 29 bp, Homo sapiens
gacgatctgggagaaattctttaccataa

SEQ ID NO: 1206 - DNA, 37 bp, Homo sapiens
agcaaagcttggagtaccatgaatattctacaaggag

SEQ ID NO: 1207 - DNA, 34 bp, Homo sapiens
gggctgtgatcaagattgataattctctgtattc

SEQ ID NO: 1208 - DNA, 326 bp, Homo sapiens
gtacctgtgattgaacctctgtctgattctcagcatttgtctcatccctctaggaatgattatcaaatggttcttttatatcactgtaaagctgccaccagaggagatttagaaatctcctttagaagttctcaaaaatagactagcatctcattttctgggtcgcttaaagtcaaaatcatgtccctaaagctattacaaacctatttctataaatttttcagggtaatcagattctttttcctagtggtacaactacttataaattataacattttaatcctaatgatactttaaaaggtgagcgcacgggcaatatttgaaag

SEQ ID NO: 1209 - DNA, 247 bp, Homo sapiens
agctcccagggttactttagaactgctggattcctttttctctagcagaaagagaagaagaacatggaggaggcatggctactcttttaagaaccccagcccagtaatggcagaccttctgctcacatttcagtatagaacttgagctcatgtttcacctaactgtaagcgagtctgtctgggaaatgcagtctagctgtgtgcctaagagaagaatggatttcagagggcagctaatcatcttttc

SEQ ID NO: 1210 - DNA, 80 bp, Homo sapiens
atcagtggaacctatcttggtttggattacatgagtaagcaaaatggaggtgaaggcggcatcattatcaatatgtcatc

SEQ ID NO: 1211 - DNA, 25 bp, Homo sapiens
taatgctggagtgaataatgagaaa

SEQ ID NO: 1212 - DNA, 123 bp, Homo sapiens
tagcgctggtggattggaatcttgaagcaggtgtacagtgtaaagctgccctggatgagcagtttgaacctcagaagactctgttcatccagtgcgatgtggctgaccagcaacaactgagag

SEQ ID NO: 1213 - DNA, 103 bp, Homo sapiens
ttgccaaatttcaggtccaggaggggagcctcttgtgtgtttattgtttgtccgtctatttcgtgagctgcgcaggcccgcgattcctctcctcttgtctata

SEQ ID NO: 1214 - DNA, 30 bp, Homo sapiens
atgcacgtgaacggcaaagtggcgctggtg

SEQ ID NO: 1215 - DNA, 173 bp, Homo sapiens
ctatccagttggtctttagggcactgaaggaaactcttcttcagaaataaccttttaacttttcttctgtcagctgcctgccaatcacggagccagaggctgaggggaggctttgagccggtctgcgagtccggaaggcaaagatcgcgaagcttggcgctccagaacgctca

SEQ ID NO: 1216 - DNA, 83 bp, Homo sapiens
tcttctcgctgagtctcctcctcggctctgacggtacagtgatataatgatgatgggtgtcacaacccgcatttgaacttgca

SEQ ID NO: 1217 - DNA, 162 bp, Homo sapiens
ccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgca

SEQ ID NO: 1218 - DNA, 30 bp, Homo sapiens
ttccccccaaactgcaataagccgccttcc

SEQ ID NO: 1219 - DNA, 57 bp, Homo sapiens
taaagagcatcttatggatgtgttcaaccttaatagtaacccatgcgctacataaag

SEQ ID NO: 1220 - DNA, 28 bp, Homo sapiens
tggaaaagtcagcctaccttgtcatttt

SEQ ID NO: 1221 - DNA, 208 bp, Homo sapiens
tgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggt

SEQ ID NO: 1222 - DNA, 53 bp, Homo sapiens
tgatgcgggtctttaccgctgtgacgtcatgtacgggattgaagacacacaag

SEQ ID NO: 1223 - DNA, 90 bp, Homo sapiens
cagggcggcaaccagcaggtacacactgaattttgaggctgctcagaaggcttgtttggacgttggggcagtcatagcaactccagagca

SEQ ID NO: 1224 - DNA, 124 bp, Homo sapiens
atcccatccgggctcccagagtaggctgttatggagataagatgggaaaggcaggagtcaggacttatggattccgttctccccaggaaacttacgatgtgtattgttatgtggatcatctgga

SEQ ID NO: 1225 - DNA, 170 bp, Homo sapiens
ggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctac

SEQ ID NO: 1226 - DNA, 300 bp, Homo sapiens
caactagccgttggagtggattccatgtcttgcagtgtgtgcacggaatggaaacagttcagtgattttcaaaagcaagcaaactgaacagcagtgatatggttaaaaccacaggaattttggcaaatggatttttagaggggtgaggaaatatcaggttaagctgtaactgtgctctgttgtgtccagagccacagagcatttttctaagtattttatattaattgcagtccttaagttttgcaatttgtttattggtgttacaatgccaaggccaactgaggctgagttaaatcctta

SEQ ID NO: 1227 - DNA, 1831 bp, Homo sapiens
cctcccgtgggaaatattgtcagttttgaacagaaagccacagtccaacctcaggctatcacagatagtttagccaccaaattacccacacctactggcagtaccaagaagccctgggatatggatgactactcaccttctgcttcaggacctcttggaaagctagacatatcagaaattaaggaagaagtgctccagagtacaactggcgtctctcattatgctacggattcatgggatggtgtcgtggaagataaacaaacacaagaatcggttacacagattgaacaaatagaagtgggtcctttggtaacatctatggaaatcttaaagcacattccttccaaggaattccctgtaactgaaacaccattggtaactgcaagaatgatcctggaatccaaaactgaaaagaaaatggtaagcactgtttctgaattggtaaccacaggtcactatggattcaccttgggagaagaggatgatgaagacagaacacttacagttggatctgatgagagcaccttgatctttgaccaaattcctgaagtcattacggtgtcaaagacttcagaagacaccatccacactcatttagaagacttggagtcagtctcagcatccacaactgtttcccctttaattatgcctgataataatggatcatccatggatgactgggaagagagacaaactagtggtaggataacggaagagtttcttggcaaatatctgtctactacaccttttccatcacagcatcgtacagaaatagaattgtttccttattctggtgataaaatattagtagagggaatttccacagttatttatccttctctacaaacagaaatgacacatagaagagaaagaacagaaacactaataccagagatgagaacagatacttatacagatgaaatacaagaagagatcactaaaagtccatttatgggaaaaacagaagaagaagtcttctctgggatgaaactctctacatctctctcagagccaattcatgttacagagtcttctgtggaaatgaccaagtcttttgatttcccaacattgataacaaagttaagtgcagagccaacagaagtaagagatatggaggaagactttacagcaactccaggtactacaaaatatgatgaaaatattacaacagtgcttttggcccatggtactttaagtgttgaagcagccactgtatcaaaatggtcatgggatgaagataatacaacatccaagcctttagagtctacagaaccttcagcctcttcaaaattgccccctgccttactcacaactgtggggatgaatggaaaggataaagacatcccaagtttcactgaagatggagcagatgaatttactcttattccagatagtactcaaaagcagttagaggaggttactgatgaagacatagcagcccatggaaaattcacaattagatttcagccaactacatcaactggtattgcagaaaagtcaactttgagagattctacaactgaagaaaaagttccacctatcacaagcactgaaggccaagtttatgcaaccatggaaggaagtgctttgggtgaagtagaagatgtggacctctctaagccagtatctactgttccccaatttgcacacacttcagaggtggaaggattagcatttgttagttatagtagcacccaagagcctactacttatgtagactcttcccataccattcctctttctgtaattcccaagacagactggggagtgttagtaccttctgttccatcagaagatgaagttctaggtgaaccctctcaagacatacttg

SEQ ID NO: 1228 - DNA, 116 bp, Homo sapiens
cagaaaccgatattgatagagagtatttcacgacttcaagtcctcctgctacacagccaacaagaccacccactgtggaagacaaagaggcctttggacctcaggcgctttctacg

SEQ ID NO: 1229 - DNA, 269 bp, Homo sapiens
gggttggctccgtcataatgatttctcctaaacacttctcaggtttggcctatgcatgtgtgttatagattggggatagtttgaaaactcattctgtagtattattcctatgggcagggtggtgagtagtgtgtaaattctttgtcttctttatgggtcagtatatccacaggcacattttcatactgctttgtcactgaaagtaaggcagctgcagtggcaggaccctgttctaggacagttgaatgcctctatgatgagacctcaga

SEQ ID NO: 1230 - DNA, 89 bp, Homo sapiens
aaaaggccattgagcttagtggttggtaccatatggcaatttacaatctgggaaatattctgatgatacatacttttcgaggaatgcta

SEQ ID NO: 1231 - DNA, 179 bp, Homo sapiens
atcagcctaatctgggtcacatcccaggaaggataaaggtctataggtgtggaaggctctttctggtcctttcagtgagctatttccaatagagcccgcctatccagagcttcccactcttgtgcataggatgtggttaagctcatgtctcagtgccacagtaggtagaggatgccatt

SEQ ID NO: 1232 - DNA, 81 bp, Homo sapiens
tcgaatgagtgatttgagtgtaattggtcatccaatagattcagaatctaaagaagatgaaccttgtagtgaagaaacaga

SEQ ID NO: 1233 - DNA, 117 bp, Homo sapiens
gtgcatgatctaatggctgaaattttacctgaattccctgacataattgaaatagacctataccacagtgaagaaaatgaagaagaagaagaagagtgtgcaaatgctactgatgtg

SEQ ID NO: 1234 - DNA, 234 bp, Homo sapiens
tgggaagcatctcgttaccactgtgcccaaggacccagaagctgcagaagctaggcgtggccagtttgaaagtgttgcaccttctcagaatttctcggacagctctgaaagtgatactcatccatttgtaatagccaaaacggaattgtctactgctgtgcaacctaatgaatctacagaaacaactgagtctcttgaagttacatggaagcctgagacttaccctgaaacatc

SEQ ID NO: 1235 - DNA, 740 bp, Homo sapiens
gctctcagggagttcttcgattccaattacagaaggctctggagaagcagaagaagatgaagatacaatgttcaccatggtaactgatttatcacagagaaatactactgatacactcattactttagacactagcaggataatcacagaaagcttttttgaggttcctgcaaccaccatttatccagtttctgaacaaccttctgcaaaagtggtgcctaccaagtttgtaagtgaaacagacacttctgagtggatttccagtaccactgttgaggaaaagaaaaggaaggaggaggagggaactacaggtacggcttctacatttgaggtatattcatctacacagagatcggatcaattaattttaccctttgaattagaaagtccaaatgtagctacatctagtgattcaggtaccaggaaaagttttatgtccttgacaacaccaacacagtctgaaagggaaatgacagattctactcctgtctttacagaaacaaatacattagaaaatttgggggcacagaccactgagcacagcagtatccatcaacctggggttcaggaagggctgaccactctcccacgtagtcctgcctctgtctttatggagcagggctctggagaagctgctgccgacccagaaaccaccactgtttcttcattttcattaaacgtagagtatgcaattcaagccgaaaaggaagtagctggcactttgtctccgcatgtggaaa

SEQ ID NO: 1236 - DNA, 37 bp, Homo sapiens
ccctgggaagagtttacatcctcagctgagggctcag

SEQ ID NO: 1237 - DNA, 281 bp, Homo sapiens
tgagcaactggtcacagtcagcagctctgttgttccagtgcttcccagtgctgtgcaaaagttttctggtacagcttcctccattatcgacgaaggattgggagaagtgggtactgtcaatgaaattgatagaagatccaccattttaccaacagcagaagtggaaggtacgaaagctccagtagagaaggaggaagtaaaggtcagtggcacagtttcaacaaactttccccaaactatagagccagccaaattatggtctaggcaagaagtcaaccctg

SEQ ID NO: 1238 - DNA, 1546 bp, Homo sapiens
ggtccacagacggtagtttccaagaccgtttcagggaattcgaggattccaccttaaaacctaacagaaaaaaacccactgaaaatattatcatagacctggacaaagaggacaaggatttaatattgacaattacagagagtaccatccttgaaattctacctgagctgacatcggataaaaatactatcatagatattgatcatactaaacctgtgtatgaagacattcttggaatgcaaacagatatagatacagaggtaccatcagaaccacatgacagtaatgatgaaagtaatgatgacagcactcaagttcaagagatctatgaggcagctgtcaacctttctttaactgaggaaacatttgagggctctgctgatgttctggctagctacactcaggcaacacatgatgaatcaatgacttatgaagatagaagccaactagatcacatgggctttcacttcacaactgggatccctgctcctagcacagaaacagaattagacgttttacttcccacggcaacatccctgccaattcctcgtaagtctgccacagttattccagagattgaaggaataaaagctgaagcaaaagccctggatgacatgtttgaatcaagcactttgtctgatggtcaagctattgcagaccaaagtgaaataataccaacattgggccaatttgaaaggactcaggaggagtatgaagacaaaaaacatgctggtccttcttttcagccagaattctcttcaggagctgaggaggcattagtagaccatactccctatctaagtattgctactacccaccttatggatcagagtgtaacagaggtgcctgatgtgatggaaggatccaatcccccatattacactgatacaacattagcagtttcaacatttgcgaagttgtcttctcagacaccatcatctcccctcactatctactcaggcagtgaagcctctggacacacagagatcccccagcccagtgctctgccaggaatagacgtcggctcatctgtaatgtccccacaggattcttttaaggaaattcatgtaaatattgaagcgactttcaaaccatcaagtgaggaataccttcacataactgagcctccctctttatctcctgacacaaaattagaaccttcagaagatgatggtaaacctgagttattagaagaaatggaagcttctcccacagaacttattgctgtggaaggaactgagattctccaagatttccaaaacaaaaccgatggtcaagtttctggagaagcaatcaagatgtttcccaccattaaaacacctgaggctggaactgttattacaactgccgatgaaattgaattagaaggtgctacacagtggccacactctacttctgcttctgccacctatggggtcgaggcaggtgtggtgccttggctaagtccacagacttctgagaggcccacgctttcttcttctccagaaataaaccctgaaactcaagcagctttaatcagagggcaggattccacgatagcagcatc

SEQ ID NO: 1239 - DNA, 102 bp, Homo sapiens
ctgatcgctgcaaaatgaacccgtgccttaacggaggcacctgttatcctactgaaacttcctacgtatgcacctgtgtgccaggatacagcggagaccagt

SEQ ID NO: 1240 - DNA, 102 bp, Homo sapiens
ttgatgaatgtcactctaatccctgtcgtaatggagccacttgtgttgatggttttaacacattcaggtgcctctgccttccaagttatgttggtgcacttt

SEQ ID NO: 1241 - DNA, 117 bp, Homo sapiens
aagggcagtgctacaaatactttgcccatcgacgcacatgggatgcagctgaacgggaatgccgtctgcagggtgcccatctcacaagcatcctgtctcacgaagaacaaatgtttg

SEQ ID NO: 1242 - DNA, 68 bp, Homo sapiens
ccatgattatcagtggataggcctcaatgacaagatgtttgagcatgacttccgttggactgatggca

SEQ ID NO: 1243 - DNA, 141 bp, Homo sapiens
tacgagaattggagacccaaccagccagacagcttcttttctgctggagaagactgtgttgtaatcatttggcatgagaatggccagtggaatgatgttccctgcaattaccatctcacctatacgtgcaagaaaggaaca

SEQ ID NO: 1244 - DNA, 124 bp, Homo sapiens
acctcgttatgaaatcaactccctgattagataccactgcaaagatggtttcattcaacgtcaccttccaactatccggtgcttaggaaatggaagatgggctatacctaaaattacctgcatg

SEQ ID NO: 1245 - DNA, 45 bp, Homo sapiens
gtggtcctttagaaagaatggactaccgtgctataacaactacta

SEQ ID NO: 1246 - DNA, 40 bp, Homo sapiens
ttttacggctgtggtatcggcagtttagggtatggagcaa

SEQ ID NO: 1247 - DNA, 101 bp, Homo sapiens
ataccaaaggacttattctatgaaatactttaaaaattcctcatcagcaaaggacaattcaataaatacatccaaacatgatcatcgttggagccggaggt

SEQ ID NO: 1248 - DNA, 279 bp, Homo sapiens
cctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatctaatttctttagttttctatttgcctccagtgcagtccatttcctaatgtataccagcctactgtactatttaaaatgctcaatttcagcaccgatggccatgtaaata

SEQ ID NO: 1249 - DNA, 280 bp, Homo sapiens
ctcagccataggtgcagtttgcttctacatgatgctaaaggctgcgaatgggatcctgatggaactaaggactccaatgtcgaactcttctttgctgcattcctttttcttcacttacaagaaaggcctgaatggaggacttttctgtaaccaggaacattttttaggggtcaaagtgctaataattaactcaaccaggtctactttttaatggctttcataacactaactcataaggttaccgatcaatgcatttcatacggatatagacctagggctc

SEQ ID NO: 1250 - DNA, 214 bp, Homo sapiens
gtgttagccttttactttcctcacacaatttggaatcatataatataggtactttgtccctgattaaataatgtgacggatagaatgcatcaagtgtttattatgaaaagagtggaaaagtatatagcttttagcaaaaggtgtttgcccattctaagaaatgagcgaatatatagaaatagtgtgggcatttcttcctgttaggtggagtgta

SEQ ID NO: 1251 - DNA, 186 bp, Homo sapiens
ggcacaaagggattggcccaatattgattctttttttataaaacctcctttggcttagaaggaatgactctagctacaataatacacagtatgtttaagcaggttcccttggttgttgcattaaatgtaatccacctttaggtattttagagcacagaacaacactgtgttgatctagtaggtttc

SEQ ID NO: 1252 - DNA, 69 bp, Homo sapiens
ggaggcgctctcacttccctggagccgcccgcttgcccgtcggtcgctagctcgctcggtgcgcgtcgt

SEQ ID NO: 1253 - DNA, 36 bp, Homo sapiens
ctcttcgtgcggctgctggctctcgccctggctctg

SEQ ID NO: 1254 - DNA, 27 bp, Homo sapiens
gccgcgaccctggcgggtcccgccaag

SEQ ID NO: 1255 - DNA, 34 bp, Homo sapiens
gtgctgcagcacagcaggctccggggccgccagc

SEQ ID NO: 1256 - DNA, 68 bp, Homo sapiens
gtgcagaaggttattggcactaataggaagtacttcaccaactgcaagcagtggtaccaaaggaaaat

SEQ ID NO: 1257 - DNA, 47 bp, Homo sapiens
gtcatcagctacgagtgctgtcctggatatgaaaaggtccctgggga

SEQ ID NO: 1258 - DNA, 55 bp, Homo sapiens
ctaccactctcaaacctttacgagaccctgggagtcgttggatccaccaccactc

SEQ ID NO: 1259 - DNA, 51 bp, Homo sapiens
gaggggcccggcagcttcaccatcttcgcccctagcaacgaggcctgggcc

SEQ ID NO: 1260 - DNA, 25 bp, Homo sapiens
atgacctccgtctgcccgggggact

SEQ ID NO: 1261 - DNA, 165 bp, Homo sapiens
tcttaccaggttgcgtctaatgccccccgttccctactgggcagaaagacttgggtgcttcctgaggagggatccttggcagaagagaggcctgggctcacgagggctgagaacatgtttcccagagttgcaaggacccatctcttaaacacagagtctgcagcc

SEQ ID NO: 1262 - DNA, 103 bp, Homo sapiens
gcaatgtcaacattgagctgctcaatgccctccgctaccatatggtgggcaggcgagtcctgactgatgagctgaaacacggcatgaccctcacctctatgta

SEQ ID NO: 1263 - DNA, 111 bp, Homo sapiens
tgctgaaagccgaccaccatgcaaccaacggggtggtgcacctcatcgataaggtcatctccaccatcaccaacaacatccagcagatcattgagatcgaggacacctttg

SEQ ID NO: 1264 - DNA, 179 bp, Homo sapiens
gacattcagcttgacctaacctgtgaaattctccatcttctttataaagtgttcccttccttgcctcccctggaaaggtcagtggtgtgtggctgcagcagcacagtgtcctctgagccctggacctgcactgtggcttccagaggtggcagttcccacatggggtactagaataaatg

SEQ ID NO: 1265 - DNA, 51 bp, Homo sapiens
agaaaatgatgttcccacatagttggcagcacgtgaacagcaattgatccc

SEQ ID NO: 1266 - DNA, 118 bp, Homo sapiens
catcagggctcaacacgatgcttgaaggtaacggccagtacacgcttttggccccgaccaatgaggccttcgagaagatccctagtgagactttgaaccgtatcctgggcgacccaga

SEQ ID NO: 1267 - DNA, 168 bp, Homo sapiens
tgcctcatttgtgcagctagattgagcccaagacctgctctggtccaagatgaacataccacctgccatgaggtgaccctcaggatatccactgcagccatgggctggggtcatcctgtcctgttgcttcagctaaccgtgtctctagcagccacactactctgaggg

SEQ ID NO: 1268 - DNA, 91 bp, Homo sapiens
gcagcggggacatgctcactatcaacgggaaggcgatcatctccaataaagacatcctagccaccaacggggtgatccactacattgatga

SEQ ID NO: 1269 - DNA, 81 bp, Homo sapiens
gagtctgatgtgtccacagccattgaccttttcagacaagccggcctcggcaatcatctctctggaagtgagcggttgacc

SEQ ID NO: 1270 - DNA, 27 bp, Homo sapiens
atctctctggacctaaccatcaccctt

SEQ ID NO: 1271 - DNA, 105 bp, Homo sapiens
acaaggaatttgcttcggaaccacataattaaagaccagctggcctctaagtatctgtaccatggacagaccctggaaactctgggcggcaaaaaactgagagtt

SEQ ID NO: 1272 - DNA, 92 bp, Homo sapiens
gttctgggtcctaaatcatgctcctgggaagctccttactgtgggacttgtattagtgtaaaaaaaaatgtcctcaataagcaggagtttgc

SEQ ID NO: 1273 - DNA, 53 bp, Homo sapiens
aagtacaactcaacatagctcttgcctgggaccaaccagcaccatttggctaa

SEQ ID NO: 1274 - DNA, 104 bp, Homo sapiens
cagccttaataacccatcccagtgtatactccttcatcttcatggataatgaccctgctacatgctctgaacaaatcaggaggcccctcgtggaagtataacca

SEQ ID NO: 1275 - DNA, 123 bp, Homo sapiens
agaacagctgcatcgcggcccacgacaagagggggaggtacgggaccctgttcacgatggaccgggtgctgacccccccaatggggactgtcatggatgtcctgaagggagacaatcgcttta

SEQ ID NO: 1276 - DNA, 103 bp, Homo sapiens
gctggtagctgccatccagtctgcaggactgacggagaccctcaaccgggaaggagtctacacagtctttgctcccacaaatgaagccttccgagccctgcca

SEQ ID NO: 1277 - DNA, 52 bp, Homo sapiens
agatttgtggtcatgaacatgtgctttgtgtcctctgaccattagacagatt

SEQ ID NO: 1278 - DNA, 111 bp, Homo sapiens
agatgccaaggaacttgccaacatcctgaaataccacattggtgatgaaatcctggttagcggaggcatcggggccctggtgcggctaaagtctctccaaggtgacaagct

SEQ ID NO: 1279 - DNA, 84 bp, Homo sapiens
gtgtcaacaaggagcctgttgccgagcctgacatcatggccacaaatggcgtggtccatgtcatcaccaatgttctgcagcctc

SEQ ID NO: 1280 - DNA, 191 bp, Homo sapiens
tgcctctcctcatgtgtgcattcacctttcttggtgctctctccccatgggccaagttctaccatgagttatgaaacattatggagaaaacatgtctttggaaatgtgagccagaaagcccaccagtgcccctcagtcacggttgttatgaatgacatgctaatggtttcactctggtcaaacctgccttt

SEQ ID NO: 1281 - DNA, 39 bp, Homo sapiens
ccaacagacctcaggaaagaggggatgaacttgcagact

SEQ ID NO: 1282 - DNA, 207 bp, Homo sapiens
ggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatg

SEQ ID NO: 1283 - DNA, 93 bp, Homo sapiens
ttccagagaggacctatcccaaatgtggaattgactgcctatgccaagtccctggaaaaggagcttcagtattgtggggctcataaaacatga

SEQ ID NO: 1284 - DNA, 106 bp, Homo sapiens
ttttgtaaagcccttgcacagctggagaaatggcatcattataagctatgagttgaaatgttctgtcaaatgtgtctcacatctacacgtggcttggaggctttta

SEQ ID NO: 1285 - DNA, 25 bp, Homo sapiens
tggtatgtagagcttagatttccct

SEQ ID NO: 1286 - DNA, 25 bp, Homo sapiens
tgcggctgcagtccaggaatagtca

SEQ ID NO: 1287 - DNA, 129 bp, Homo sapiens
ctgcgtgtccacatacgaggggacagggctgaggatgaggagaaccctggggacccagaagaccgtgccttgcctggaagtcctgcctgtaggcctgaaggacttgccctaacagagcctcaacaacta

SEQ ID NO: 1288 - DNA, 33 bp, Homo sapiens
cctacttcagccccttggtgtgagcagcttctc

SEQ ID NO: 1289 - DNA, 29 bp, Homo sapiens
ggccttcgtgtgtctgagtctcttcactg

SEQ ID NO: 1290 - DNA, 101 bp, Homo sapiens
agtcagttcaacgtcgaggtcggcagaagtgacaagctttccctgcctggctttgagaacctcacagcaggatataacaaatttctcaggcccaattttgg

SEQ ID NO: 1291 - DNA, 53 bp, Homo sapiens
gagaacccgtacagatagcgctgactctggacattgcaagtatctctagcatt

SEQ ID NO: 1292 - DNA, 48 bp, Homo sapiens
gtaagcgctgttcctttgtactctacccaagtagtccctctctgtgtg

SEQ ID NO: 1293 - DNA, 48 bp, Homo sapiens
tacacagccaccatatacctccgacagcgctggatggaccagcggctg

SEQ ID NO: 1294 - DNA, 35 bp, Homo sapiens
tcctctgggtgccagatacttacattgtggagtcc

SEQ ID NO: 1295 - DNA, 28 bp, Homo sapiens
tgggaaacaggctcatccgcctcttctc

SEQ ID NO: 1296 - DNA, 34 bp, Homo sapiens
ctgttgcatgtaacatggatctgtctaaataccc

SEQ ID NO: 1297 - DNA, 90 bp, Homo sapiens
acgactctgtgcgtggactggaacacctgcggcttgctcagtacaccatagagcggtatttcaccttagtcaccagatcgcagcaggaga

SEQ ID NO: 1298 - DNA, 135 bp, Homo sapiens
tacactagattggtcttacagtttgagcttcggaggaatgttctgtatttcattttggaaacctacgttccttccactttcctggtggtgttgtcctgggtttcattttggatctctctcgattcagtccctgca

SEQ ID NO: 1299 - DNA, 153 bp, Homo sapiens
accacactgatgatcgggtcccgcacttctcttcccaacaccaactgcttcatcaaggccatcgatgtgtacctggggatctgctttagctttgtgtttggggccttgctagaatatgcagttgctcactacagttccttacagcagatggca

SEQ ID NO: 1300 - DNA, 145 bp, Homo sapiens
ctccagctttaaacggaagatcagctttgccagcattgaaatttccagcgacaacgttgactacagtgacttgacaatgaaaaccagcgacaagttcaagtttgtcttccgagaaaagatgggcaggattgttgattatttcaca

SEQ ID NO: 1301 - DNA, 44 bp, Homo sapiens
ttgatttttatgctagccaatgtattttactgggcatactacat

SEQ ID NO: 1302 - DNA, 900 bp, Homo sapiens
ctcagggctgtttattcggtggctccctggtttgcatttacctcatataaagaatgggaaggagaccattgggtaaccctcaagtgtcagaagttgtttctaaagtaactatacatgttttttactaaatctctgcagtgcttataaaatacattgttgcctatttagggagtaacattttctagtttttgtttctggttaaaatgaaatatgggcttatgtcaattcattggaagtcaatgcactaactcaataccaagatgagtttttaaataatgaatattatttaataccacaacagaattatccccaatttccaataagtcctatcattgaaaattcaaatataagtgaagaaaaaattagtagatcaacaatctaaacaaatccctcggttctaagatacaatggattccccatactggaaggactctgaggctttattcccccactatgcatatcttatcattttattattatacacacatccatcctaaactatactaaagcccttttcccatgcatggatggaaatggaagatttttttttaacttgttctagaagtcttaatatgggctgttgccatgaaggcttgcagaattgagtccattttctagctgcctttattcacatagtgatggggtactaaaagtactgggttgactcagagagtcgctgtcattctgtcattgctgctactctaacactgagcaacactctcccagtggcagatcccctgtatcattccaagaggagcattcatccctttgctctaatgatcaggaatgatgcttattagaaaacaaactgcttgacccaggaacaagtggcttagcttaagtaaacttggctttgctcagatccctgatccttccagctggtctgctatgagtggctta

SEQ ID NO: 1303 - DNA, 781 bp, Homo sapiens
gctatgccgcttgatgtaacttttaaagatgttatcaaatgttaaatgcctcattctgcgttaatttgctgttggctgttttgtgaacacaaaataaacttgagatttttttttttttttttttttgtgaaactcctccaaagccaatttcagcccttggtaagcttgcagacagttactgatcttaaatttaattttaaaagacaatgtatcttaattataatttagctttttaaaacaatgagatagctttacatttcccctttgtttgaatgagaaaatggatcttgggttgctatgctagaacacttgtagattgctgggtcctttgtaagggggccatggacacaccacactttctttcaatccttacatttgaagcattgatattcttcaaaaccttcttgttacatgtgcgcaatagaaatttctaatgttcatgacttttatctttcctgtccatcaattcactggttgtaaatgcttcctgagagctgtctaggtctgtatcccagattgttgcttaatgacatctgacagatgcattgttttctgaaatcagcttaagacaccaattgtggcaactggaaactcattacctgctgcattggatcaactatggaagttggagcaggggtgggcggaggtcacctaaccaatcaatggaaggcaactcacacctgctccaagcctcagctttgagaaacaaacacgtttataagaaaaaatatatagctattattacagaagtgaatatgttgtgctctcttactgctcttgg

SEQ ID NO: 1304 - DNA, 364 bp, Homo sapiens
ttggcgcaatggcaggaactagtcaagggcactttcagatctggaaagaggaaagaggaggtagaaaatcactcttttgtgtttcttaaactgtcaatcaagcaagaaaatttattccaccccttcatatttgctctaaaatctggggccagtagttgaaatgtgatcttgttctttctcagccttttggcaatttaatgccaaatattccaaatgttagatgaatggcagtaataaaatgattcaaatgtttgataaatacaagctgagagcaaaatctggactctgaaaaatcggaactattttatcatgttgctaaaatgagagcatcattttcttccctctctgtaagtgcggtagttta

SEQ ID NO: 1305 - DNA, 762 bp, Homo sapiens
tgcccagagtgccagagttttagccaaaggtgtacttacttccttatttatctgcaaaaggatggaaactgtgggagtcaaagcctattttgctgagtgttcccactggagtctctggtagaattagcaggtcatgctgtcaaaatcatggacaaaggctgggtgcagtggctcatgcctataatcccagcactttgggaggccaaggtgggcggatcacctgagctcaggagtttgagaccagcctgggcaacatggggaaactccatctctacaaaatatacaaaatattagccagccatcgtggtgcgtgcctgtggtcccagtttcttgggaggctgaggcgggagtatcatttgagccaggaggttgaggttgcagtgagctgagatcacatcactgcactccatcctgggtgacagagagagaccctgtctcaaaaaaaaaaaaaaagaacaaagtcttagcggggggtctctatgtccccaagtggctctctaaggggatccattagcgtataattgaatatcaaagggaattttaccttaaacatatatcaagtctatactcagctaatcgttttgtctaaacacagccttgttagcatttgaatttacaaatattcatttgcttatttgcagtgttccttttgcttttagaataaatcataaatatttccccaatactgtcaagatacttcttcaactttgtccctgaaccatcagctttctttagggtccgggtatcctttacacttcaatg

SEQ ID NO: 1306 - DNA, 112 bp, Homo sapiens
gaagagtccgttcatgtcatgtggtttgggatgaaccaggggtctggccccatcgggtcacaggtgatggcaaatagaaaagaagcaaatggaggaaatagtcggataagta

SEQ ID NO: 1307 - DNA, 441 bp, Homo sapiens
gctggcttggctttagtcttacatttaaattctttgaaagtggctcccagtgctattcagggtcctttcttgaggccagactcatcaccatctactattgattttacagtgcactgacagtttacaggaaggagaagaacagaatttctgcacactacacaacatgtgggcttcctgtagctccagggacatgtagctttggtgaaactggggttttgtaacctctgaatgatatggacttagtgaattctaaggaactcagggggcacgtggtcaggctccaccgcacagaagagccacagtctccagactcatggcgttccctccagaactccccattcccctctgagcatatttctatgctgctgcttcttgtgacttacatgaggcatctcagcttcttcatgtttgtagggatggttccctaagcctgttcaagta

SEQ ID NO: 1308 - DNA, 1373 bp, Homo sapiens
acctggtccacaccggcagaagttacagtagactgtgaggcaccccaccttgctcctgatgcagtttctgtgccattgctggtgctggtggaggcagcggagcagaggctcaggcacaatgaagcgtggatgtgttctgcaggttgctgcaaaactcaccttattctgacttttggatttcatggcattccaggaagctccttgccatgctgttggcctggaagtccacctgtctggtccatagtgacgtcctgaagagccagtctgtaaaataaccaaccacttacttagcgtttggatagactccatgccttctctctccctgcaaagaaaaatcttgaacatttatgatgtcaattagtgaaagtattgaaaatactaaattataactaaaagcaactttttatgttattgaaaatattgaaagaactgatattaatgataatcattttatttttcatctctctgatatacccaatgtgtggcaatcagcccctaccacgagcattaataccatgtaaagctggctttctggagtctgccaggtccacacgaagtgctacccccagtttctgctgttacttgctgcctccaggccaggggagcaggagatgctcagctctggtgccttttcttttatttcagtgctgccttcccacccacccagtccattcaccctcacctctccctgcatggaggcaacagcatttcaagatgtaccttgggaagtcaggatagctggaagtaagggtttttgggatccctgtggtctcttcactgatcatcgataagcatttaagagtgtgctaacaccattcacagaggtccctggaaaaaaatatataattttctcacaaacaaccaatacataacctatggcagttggttgaataattattgaaaaaaagaacacgactgaaaaagttcatctgatgcctctgagcatgtgataaagtcctgggtagacacggaaacgtgttcttacaaatgaaccttcggatctatgaaagaaaatatagtagggggactaaggaacatagaattttattagcatatgtgattttacccttatctttgtttctaatttaaagaaacaatttcagaaagtgttagaagaattctatgtttaataatgaatattgttgagttcaaaatattctcatatacccagatttacagagatgacacagtattgaaatggcaggtgggctctgtaagttattttggattaatgacattcagggtctttgcagtggggacttcatgttgcctctcactcattcctcatatgtcagagtcttctgtctatatgcacatgctcaaagtccatactcagtaggggaaatctagccggatggttctccaattgttcc

SEQ ID NO: 1309 - DNA, 98 bp, Homo sapiens
caaaaacaacttgatcctagaggaaagaaacaaatacttcaacccacatctcactgggaagacctattctaatgcctactttacagatctcaataatt

SEQ ID NO: 1310 - DNA, 123 bp, Homo sapiens
acatgttccacatgatcgccgtggggctgagcagctccatcctcggctgcctcctcaccctgctcgtctatacttactgccagcggtaccagcagcaatcccacgatgcgactgtcatccacc

SEQ ID NO: 1311 - DNA, 36 bp, Homo sapiens
atctgtggcaagatccagtagcgtagaagagaaaag

SEQ ID NO: 1312 - DNA, 124 bp, Homo sapiens
tgtgaagcctctggcgtccaagtccgcgcccgccagtgcatcctcctgttccccatgggcagccagtgctccgggaacaccacggagagccggccgtgtgtgtttgactctaatttcatcccag

SEQ ID NO: 1313 - DNA, 33 bp, Homo sapiens
gcacacagaagaggcactctgcaacacgcagcc

SEQ ID NO: 1314 - DNA, 27 bp, Homo sapiens
tgaggacccgctcttgctccaatccag

SEQ ID NO: 1315 - DNA, 65 bp, Homo sapiens
atggcgtgtggtcttgctggtccccctggacaaaatgttcagcaacatgcggcggtggacactat

SEQ ID NO: 1316 - DNA, 170 bp, Homo sapiens
tgggagatactctgcccacacggtcaacggggcttggtcagcctggacgtcgtggtcacagtgcagccgtgactgcagcaggggcattcggaaccggaagcgtgtttgcaacaaccccgaacccaagtatgggggaatgccttgccttggcccatctctggaataccagg

SEQ ID NO: 1317 - DNA, 118 bp, Homo sapiens
ggcggccactatgagcaacgattccgatacacatgcaaagcccgcctggctgatccgaatttgctggaagtgggaagacagagaatcgaaatgcggtactgttctagcgacggcacca

SEQ ID NO: 1318 - DNA, 77 bp, Homo sapiens
tgggaacggtgcacagcccaatgcgggggtggcattcaagctcgccgcaggatctgtgagaatgggcctgactgtgc

SEQ ID NO: 1319 - DNA, 26 bp, Homo sapiens
ctatgtcccccacacatgttctggac

SEQ ID NO: 1320 - DNA, 89 bp, Homo sapiens
atcggcttccaggtgcggcagcgctcctgcagcaaccccactcccaggcacgggggccgggtgtgcgtgggacagaaccgcgaggaaag

SEQ ID NO: 1321 - DNA, 171 bp, Homo sapiens
tctcaccgtggatgggcactttggtgtgtggtctccgtggacgccttgcacgcacacagatggcagcgccgtgggatcctgcctctgtcgaacccgctcctgcgacagcccggccccgcagtgtggtggctggcagtgcgagggccctggcatggagatcgccaactgttc

SEQ ID NO: 1322 - DNA, 31 bp, Homo sapiens
aggagagcctgagcatgacgcagtgggaaca

SEQ ID NO: 1323 - DNA, 169 bp, Homo sapiens
ccctgaatcagacctcaagcagctgtttgctggaagagattgagctcttccctgagaggcggagggagcccatcaggagcctgcagatcctgcacagccagagtgtcctgttcgtgggcctgcgggagcacgtggtcaagatccccctgaagaggtgccagttctaccg

SEQ ID NO: 1324 - DNA, 167 bp, Homo sapiens
gtgaacctgaccgagagaaatctgcaggatgctcagaagttcattctgatgcatgaggtggtacagccagtgaccacagtgccctccttcatggaggacaatagccgcttttcccacgtggcagtcgacgtggtgcagggcagagaagcgctcgtccacatcatcta

SEQ ID NO: 1325 - DNA, 147 bp, Homo sapiens
tttttccgagaaaatgcagtagagcatgactgtgggaaaacagtgttctccagagctgcccgggtgtgcaagaacgatattggtgggcgcttcctgctggaagacacctggaccacattcatgaaggctcgcctgaactgctcccgt

SEQ ID NO: 1326 - DNA, 183 bp, Homo sapiens
tgatcagatcagtggcatggcccgctgtccctacagtccccagcacaattccacagcgctcctcacagctggtggggagctctatgctgctacagccatggattttccaggacgtgatcctgccatttaccgaagcctaggcattttacctcctctccgcacggcgcagtacaactccaaatg

SEQ ID NO: 1327 - DNA, 52 bp, Homo sapiens
ggtggcgaccggttattcacctgtgggaccaatgcattcacgcctgtctgca

SEQ ID NO: 1328 - DNA, 48 bp, Homo sapiens
tgtgatgaagctaccaaaaaggcctgttacagcaaaggcaaatcaaag

SEQ ID NO: 1329 - DNA, 34 bp, Homo sapiens
aactacctcttcaggttacagcttgaggatctgt

SEQ ID NO: 1330 - DNA, 70 bp, Homo sapiens
ccctggttacgggagttcagagcgaagaatgctgtggatttctcgcagttaacatttgacccaggacaga

SEQ ID NO: 1331 - DNA, 105 bp, Homo sapiens
acctgtgttatagcatggctgttctcaagcctggggctgtggagactcgcccacccagaggcccagggtacgactcagtgccagagaaccgagcatccagtcatc

SEQ ID NO: 1332 - DNA, 35 bp, Homo sapiens
aagacacgtgcccagagtcagaggccccttgccca

SEQ ID NO: 1333 - DNA, 86 bp, Homo sapiens
gttggtgtgtgagacttgggctggagtgcccacgtggctgtggagtcagtgtgattcatgattgaggaaacgcgtcctccatcctc

SEQ ID NO: 1334 - DNA, 273 bp, Homo sapiens
gagctggcttggacacccaactttgccacctcgagggtcgtctctgctgggcgcgaacctgcccacccaccggttggccgcgcgctcggggaccgtgctcgtggcccccaagccggtgcccccattctggaactcagcgagtagggggcggctctggggaagtggcagggggcggctgcagctgctgcctccacttccctagccaggtgctgaagaggatcctcggagccgctctggcccccaggcgctggatgactggcaccagcgctcctc

SEQ ID NO: 1335 - DNA, 192 bp, Homo sapiens
cgtgctcatgggaaacaaacgactccagggtgtgtgccgccgatttgcaatatgaggctgatctactgttcccactgttttattccctgctgctatatctcggctgggaaatgtacgctgtggaccccgcatcttcataatgatggtccctcaatgatcaaccaccttccacgtagcatccatacagtagtc

SEQ ID NO: 1336 - DNA, 29 bp, Homo sapiens
aagaaactcaatgtcaaactgctgttgaa

SEQ ID NO: 1337 - DNA, 25 bp, Homo sapiens
acaacatccgggagatgctgatggc

SEQ ID NO: 1338 - DNA, 31 bp, Homo sapiens
ggccttattgttgaataaatgtatctgaata

SEQ ID NO: 1339 - DNA, 31 bp, Homo sapiens
aaccaaggttttgaaatcccatcaggtcacc

SEQ ID NO: 1340 - DNA, 233 bp, Homo sapiens
agcaactgaaaccttagcatgtctcaagcatcatgctaatattccctgtcttacttgtgcttatgactaagaaaacatcatgagcatgtataggatggcttcttataacttggggcaaatgccagaagatgaggtgtaaataaagtgcaacaggagtgaagcagagatacatattttttattaaaaggggccaagaaaggatccatgaaaagaatagaatgccagccgggtgc

SEQ ID NO: 1341 - DNA, 84 bp, Homo sapiens
caatgaacttaatggatgcaccaagatatatgaccctgtctgtgggactgatggaaatacttatcccaatgaatgcgtgttatg

SEQ ID NO: 1342 - DNA, 30 bp, Homo sapiens
taacactggagctgactccctgggaagaga

SEQ ID NO: 1343 - DNA, 55 bp, Homo sapiens
atgaaggtaacaggcatctttcttctcagtgccttggccctgttgagtctatctg

SEQ ID NO: 1344 - DNA, 164 bp, Homo sapiens
tggaggccaggctatgacacagagtcaatcaataaccagggagatctgtgatatagcccagtaggtggggccttgctgccatctgccatatgacccttccagtcccaggcttctgaagagacgtggtaagtgcggtgcagttttcaactgacctctggacgcag

SEQ ID NO: 1345 - DNA, 25 bp, Homo sapiens
ataatcctttctgccgacccctagt

SEQ ID NO: 1346 - DNA, 30 bp, Homo sapiens
tttctagcctatttacctgcaggctgagcc

SEQ ID NO: 1347 - DNA, 125 bp, Homo sapiens
agtggccaaaagctagacagatccccgttcctgacatcacagcagcctccaacacaaggctccaagacctaggctcatggacgagatgggaaggcacagggagaagggataaccctacacccaga

SEQ ID NO: 1348 - DNA, 95 bp, Homo sapiens
ctggctctttcgtcacccttggacaagacaaaccaagtcggaacagcagataacaatgcagcaaggccctgctgcccaatctccatctgtcaaca

SEQ ID NO: 1349 - DNA, 27 bp, Homo sapiens
gcagcagaggcggtcttcaacatcctg

SEQ ID NO: 1350 - DNA, 143 bp, Homo sapiens
gtggggagttacacaaatccatgatggtcattattggacctgagcagggggcaggggagggtggacagtccttaactgctctgcaggtccaggatgttagaaaggggcagggacaacaaatgggtgaccccaacctcaacctg

SEQ ID NO: 1351 - DNA, 37 bp, Homo sapiens
tgggccactctccaacattcctgggatgtccatttca

SEQ ID NO: 1352 - DNA, 25 bp, Homo sapiens
gaactggaggacccgtcttctgggc

SEQ ID NO: 1353 - DNA, 130 bp, Homo sapiens
cccaagtgcgacgagaacggcaactatctgccactccagtgctatgggagcatcggctactgctggtgtgtcttccccaacggcacggaggtccccaacaccagaagccgcgggcaccataactgcagtg

SEQ ID NO: 1354 - DNA, 52 bp, Homo sapiens
agtgccaggaagaggtcagccacatccctgctgtccacccgggttcattcag

SEQ ID NO: 1355 - DNA, 78 bp, Homo sapiens
tttgagagctggatgcaccattggctcctgtttgaaatgagcaggcactccttggagcaaaagcccactgacgctcca

SEQ ID NO: 1356 - DNA, 74 bp, Homo sapiens
tacccgccactgaaggggagcttcccggagaacctgagacaccttaagaacaccatggagaccatagactggaa

SEQ ID NO: 1357 - DNA, 87 bp, Homo sapiens
ctctggattactgaatacaagggtgacccttaaatgttatatgtagtctggcctctgcatttttgagataaacaggctcggctgggt

SEQ ID NO: 1358 - DNA, 51 bp, Homo sapiens
aatgccaccaagtatggcaacatgacagaggaccatgtgatgcacctgctc

SEQ ID NO: 1359 - DNA, 61 bp, Homo sapiens
agcctgtgagcaagatgcgcatggccaccccgctgctgatgcaggcgctgcccatgggagc

SEQ ID NO: 1360 - DNA, 93 bp, Homo sapiens
tctccctccggtttggaattccagcccttcctcatctgggtctgataccctcctccctgggcaccggggccacacttaccctcgttcctgtcc

SEQ ID NO: 1361 - DNA, 56 bp, Homo sapiens
ccgcctacttcctgtaccagcagcagggccggctggacaaactgacagtcacctcc

SEQ ID NO: 1362 - DNA, 32 bp, Homo sapiens
aggcttttccatcctggtgactctgctcctcg

SEQ ID NO: 1363 - DNA, 59 bp, Homo sapiens
gatgaccagcgcgaccttatctccaacaatgagcaactgcccatgctgggccggcgccc

SEQ ID NO: 1364 - DNA, 33 bp, Homo sapiens
agcaggagctgtcgggaagatcagaagccagtc

SEQ ID NO: 1365 - DNA, 37 bp, Homo sapiens
cggagtggccttctgtggacgaatcagattcctctcc

SEQ ID NO: 1366 - DNA, 373 bp, Homo sapiens
tgggactccatgctccttgagaggagaaatgcaataactctgggaggggctcgagagggctggtccttatttatttaacttcacccgagttcctctgggtttctaagcagttatggtgatgacttagcgtcaagacatttgctgaactcagcacattcgggaccaatatatagtgggtacatcaagtccatctgacaaaatggggcagaagagaaaggactcagtgtgtgatccggtttctttttgctcgcccctgttttttgtagaatctcttcatgcttgacatacctaccagtattattcccgacgacacatatacatatgagaatataccttatttatttttgtgtaggtgtctgccttcacaaatgtc

SEQ ID NO: 1367 - DNA, 288 bp, Homo sapiens
caggcaggcatttcccggtcagccaccatctgccttgcttaccttatgaggactaatcgagtcaagctggacgaggcctttgagtttgtgaagcagaggcgaagcatcatctctcccaacttcagcttcatgggccagctgctgcagtttgagtcccaggtgctggctccgcactgttcggcagaggctgggagccccgccatggctgtgctcgaccgaggcacctccaccaccaccgtgttcaacttccccgtctccatccctgtccactccacgaacagtgcgctg

SEQ ID NO: 1368 - DNA, 29 bp, Homo sapiens
ctggttcaacgaggccattgacttcatag

SEQ ID NO: 1369 - DNA, 72 bp, Homo sapiens
gccttgatcaacgtctcagccaattgtcccaaccattttgagggtcactaccagtacaagagcatccctgtg

SEQ ID NO: 1370 - DNA, 46 bp, Homo sapiens
tgccctttctgtacctgggcagtgcgtatcacgcttcccgcaagga

SEQ ID NO: 1371 - DNA, 114 bp, Homo sapiens
gatacgaagcgttttcggcttcctgcccggagctgtgcagcaaacagtcgacccccatggggctcagccttcccctgagtactagcgtccctgacagcgcggaatctgggtgca

SEQ ID NO: 1372 - DNA, 176 bp, Homo sapiens
tggactgccgctccttcttcgctttcaacgccggccacatcgccggctctgtcaacgtgcgcttcagcaccatcgtgcggcgccgggccaagggcgccatgggcctggagcacatcgtgcccaacgccgagctccgcggccgcctgctggccggcgcctaccacgccgtggtgttg

SEQ ID NO: 1373 - DNA, 142 bp, Homo sapiens
agcgagcagcgacctcgcgagccttccgcactcccgcccggttccccggccgtccgcctatccttggccccctccgctttctccgcgccggcccgcctcgcttatgcctcggcgctgagccgctctcccgattgcccgccga

SEQ ID NO: 1374 - DNA, 89 bp, Homo sapiens
acggaggctcccacccgcggatcaacactctgggccgcatgatccgcgccgagtctggcccggacctgcgctacgaggtgaccagcggc

SEQ ID NO: 1375 - DNA, 50 bp, Homo sapiens
caggatgtactattctcggcgcggcgtgatcaccgaccagaactcggacg

SEQ ID NO: 1376 - DNA, 99 bp, Homo sapiens
tcaaaccggcacgatgtccaggcaccagaaccagaacaccatccaggagctgctgcagaactgctccgactgcttgatgcgagcagagctcatcgtgca

SEQ ID NO: 1377 - DNA, 136 bp, Homo sapiens
ggagatggaatacaactgactcggagtcgagaattggatgagtgttttgcccaggccaatgaccaaatggaaatcctcgacagcttgatcagagagatgcggcagatgggccagccctgtgatgcttaccagaaaa

SEQ ID NO: 1378 - DNA, 130 bp, Homo sapiens
gagcaaatgcgagccctttataaagccatcagtgtccctcgagtccgcagggccagctccaagggtggtggaggctacacttgtcagagtggctctggctgggatgagttcaccaaacatgtcaccagtg

SEQ ID NO: 1379 - DNA, 34 bp, Homo sapiens
cgcgagaaatctgctatctaccagttggaggagg

SEQ ID NO: 1380 - DNA, 111 bp, Homo sapiens
gaacatcattcaggccacgtccagggagatcatgtggatcaatgactgcgaggaggaggagctgctgtacgactggagcgacaagaacaccaacatcgctcagaaacagga

SEQ ID NO: 1381 - DNA, 27 bp, Homo sapiens
aaagagctcaataagctgaaacaagaa

SEQ ID NO: 1382 - DNA, 37 bp, Homo sapiens
gttggattcttcagatcaccaagtgcattgatgttca

SEQ ID NO: 1383 - DNA, 86 bp, Homo sapiens
tttgaagaggcgcagtctactgaagcatacctgaaggggctccaggactccatcaggaagaagtacccctgcgacaagaacatgcc

SEQ ID NO: 1384 - DNA, 116 bp, Homo sapiens
tccttgaatacaagcgtcaggtgcagaacttggtaaacaagtctaagaagattgtacagctgaagcctcgtaacccagactacagaagcaataaacccattattctcagagctctc

SEQ ID NO: 1385 - DNA, 125 bp, Homo sapiens
tgcataagggggatgagtgtatcctgaaggacaacaacgagcgcagcaagtggtacgtgacgggcccgggaggcgttgacatgcttgttccctctgtggggctgatcatccctcctccgaaccca

SEQ ID NO: 1386 - DNA, 97 bp, Homo sapiens
gattgagcagtactacgaagccatcttggctctgtggaaccagctctacatcaacatgaagagcctggtgtcctggcactactgcatgattgacata

SEQ ID NO: 1387 - DNA, 131 bp, Homo sapiens
cgatagccgaccttgagttacattaccaagagttcatcagaaatagccaaggctcagagatgtttggagatgatgacaagcggaaaatacagtctcagttcaccgatgcccagaagcattaccagaccctg

SEQ ID NO: 1388 - DNA, 103 bp, Homo sapiens
ttcacaagcaattgctgaggttctcaaccagcttaaagatatgcttgccaacttcagaggttctgaaaagtactgctatttacagaatgaagtatttggacta

SEQ ID NO: 1389 - DNA, 92 bp, Homo sapiens
gacatgttaaaggtttatgaagccaggctcactgaggaggaaactgtctgcctggacctggataaagtggaagcttaccgctgtggactgaa

SEQ ID NO: 1390 - DNA, 155 bp, Homo sapiens
acttgaagaagtcgttgttggccactatgaagacagaactacagaaagcccagcagatccactctcagacttcacagcagtatccactttatgatctggacttgggcaagttcggtgaaaaagtcacacagctgacagaccgctggcaaaggata

SEQ ID NO: 1391 - DNA, 116 bp, Homo sapiens
cgtgataactatcaggctttctgcaagtggctctatgatgctaaacgccgccaggattccttagaatccatgaaatttggagattccaacacagtcatgcggtttttgaatgagca

SEQ ID NO: 1392 - DNA, 78 bp, Homo sapiens
gctggcctcatacacctcaggactggaaactctgctgaacatacctatcaagaggaccatgattcagtccccttctgg

SEQ ID NO: 1393 - DNA, 76 bp, Homo sapiens
tgcagatgttcatgctcggtacattgaactacttacaagatctggagactattacaggttcttaagtgagatgctg

SEQ ID NO: 1394 - DNA, 236 bp, Homo sapiens
tcagactggcccgagatgccaactcggaaaactgtaataagaacaaattcctggatcagaacctgcagaaataccaggcagagtgttcccagttcaaagcgaagcttgcgagcctggaggagctgaagagacaggctgagctggatgggaagtcggctaagcaaaatctagacaagtgctacggccaaataaaagaactcaatgagaagatcacccgactgacttatgagattgaa

SEQ ID NO: 1395 - DNA, 234 bp, Homo sapiens
ggcgagctgaagaaaacgcccttcagcaaaaggcctgtggctctgagataatgcagaagaagcagcatctggagatagaactgaagcaggtcatgcagcagcgctctgaggacaatgcccggcacaagcagtccctggaggaggctgccaagaccattcaggacaaaaataaggagatcgagagactcaaagctgagtttcaggaggaggccaagcgccgctgggaatatgaaa

SEQ ID NO: 1396 - DNA, 45 bp, Homo sapiens
gtaagaaacaattatgatgaggagatcattagcttaaaaaatcag

SEQ ID NO: 1397 - DNA, 37 bp, Homo sapiens
tttgagaccgagatcaacatcaccaagaccaccatcc

SEQ ID NO: 1398 - DNA, 967 bp, Homo sapiens
gctaccgggctcagatagacaatctcacccgagaaaacaggagcttatctgaagaaataaagaggctgaagaacactctaacccagaccacagagaatctcaggagggtggaagaagacatccaacagcaaaaggccactggctctgaggtgtctcagaggaaacagcagctggaggttgagctgagacaagtcactcagatgcgaacagaggagagcgtaagatataagcaatctcttgatgatgctgccaaaaccatccaggataaaaacaaggagatagaaaggttaaaacaactgatcgacaaagaaacaaatgaccggaaatgcctggaagatgaaaacgcgagattacaaagggtccagtatgacctgcagaaagcaaacagtagtgcgacggagacaataaacaaactgaaggttcaggagcaagaactgacacgcctgaggatcgactatgaaagggtttcccaggagaggactgtgaaggaccaggatatcacgcggttccagaactctctgaaagagctgcagctgcagaagcagaaggtggaagaggagctgaatcggctgaagaggaccgcgtcagaagactcctgcaagaggaagaagctggaggaagagctggaaggcatgaggaggtcgctgaaggagcaagccatcaaaatcaccaacctgacccagcagctggagcaggcatccattgttaagaagaggagtgaggatgacctccggcagcagagggacgtgctggatggccacctgagggaaaagcagaggacccaggaagagctgaggaggctctcttctgaggtcgaggccctgaggcggcagttactccaggaacaggaaagtgtcaaacaagctcacttgaggaatgagcatttccagaaggcgatagaagataaaagcagaagcttaaatgaaagcaaaatagaaattgagaggctgcagtctctcacagagaa

SEQ ID NO: 1399 - DNA, 1086 bp, Homo sapiens
aatccagccattccttcggggtgcaggatctatcgctggagcatctgcttctcctaaggaaaaatactctttggtagaggccaagagaaagaaattaatcagcccagaatccacagtcatgcttctggaggcccaggcagctacaggtggtataattgatccccatcggaatgagaagctgactgtcgacagtgccatagctcgggacctcattgacttcgatgaccgtcagcagatatatgcagcagaaaaagctatcactggttttgatgatccattttcaggcaagacagtatctgtttcagaagccatcaagaaaaatttgattgatagagaaaccggaatgcgcctgctggaagcccagattgcttcagggggtgtagtagaccctgtgaacagtgtctttttgccaaaagatgtcgccttggcccgggggctgattgatagagatttgtatcgatccctgaatgatccccgagatagtcagaaaaactttgtggatccagtcaccaaaaagaaggtcagttacgtgcagctgaaggaacggtgcagaatcgaaccacatactggtctgctcttgctttcagtacagaagagaagcatgtccttccaaggaatcagacaacctgtgaccgtcactgagctagtagattctggtatattgagaccgtccactgtcaatgaactggaatctggtcagatttcttatgacgaggttggtgagagaattaaggacttcctccagggttcaagctgcatagcaggcatatacaatgagaccacaaaacagaagcttggcatttatgaggccatgaaaattggcttagtccgacctggtactgctctggagttgctggaagcccaagcagctactggctttatagtggatcctgttagcaacttgaggttaccagtggaggaagcctacaagagaggtctggtgggcattgagttcaaagagaagctcctgtctgcagaacgagctgtcactgggtataatgatcctgaaacaggaaacatcatctctttgttccaagccatgaataaggaactcatcgaaaagggccacggtattcgcttattaga

SEQ ID NO: 1400 - DNA, 344 bp, Homo sapiens
aaatgtctgttcaggaggcctacaagaagggcctaattgattatgaaaccttcaaagaactgtgtgagcaggaatgtgaatgggaagaaataaccatcacgggatcagatggctccaccagggtggtcctggtagatagaaagacaggcagtcagtatgatattcaagatgctattgacaagggccttgttgacaggaagttctttgatcagtaccgatccggcagcctcagcctcactcaatttgctgacatgatctccttgaaaaatggtgtcggcaccagcagcagcatgggcagtggtgtcagcgatgatgtttttagcagctcccgacatgaatcagta

SEQ ID NO: 1401 - DNA, 52 bp, Homo sapiens
agatttccaccatatccagcgtcaggaatttaaccataaggagcagctcttt

SEQ ID NO: 1402 - DNA, 115 bp, Homo sapiens
tacagaaggtatagagcggggcatcgttgacagcatcacgggtcagaggcttctggaggctcaggcctgcacaggtggcatcatccacccaaccacgggccagaagctgtcactt

SEQ ID NO: 1403 - DNA, 56 bp, Homo sapiens
ccagggtgtgattgaccaagacatggccaccaggctgaagcctgctcagaaagcct

SEQ ID NO: 1404 - DNA, 62 bp, Homo sapiens
agaaaaatggctcccgtatgaggctggccagcgcttcctggagttccagtacctcacgggag

SEQ ID NO: 1405 - DNA, 102 bp, Homo sapiens
tgggaggataagcaccgaagaagccatccggaaggggttcatagatggccgcgccgcacagaggctgcaagacaccagcagctatgccaaaatcctgacctg

SEQ ID NO: 1406 - DNA, 27 bp, Homo sapiens
tagaagatatcactgggctgcgccttc

SEQ ID NO: 1407 - DNA, 168 bp, Homo sapiens
ttacaacatgtcttcggctccggggtcccgctccggctcccgctcgggatctcgctccggatctcgctccgggtcccgcagtgggtcccggagaggaagctttgacgccacagggaattcttcctactcttattcctactcatttagcagtagttctattgggcacta

SEQ ID NO: 1408 - DNA, 30 bp, Homo sapiens
agttgggagtggttgctataccttgacttc

SEQ ID NO: 1409 - DNA, 516 bp, Homo sapiens
tcccggtgcttgcagtagagtgataggacattctatgcttacagaaaatatagccatgattgaaatcaaatagtaaaggctgttctggctttttatcttcttagctcatcttaaataagcagtacacttggatgcagtgcgtctgaagtgctaatcagttgtaacaatagcacaaatcgaacttaggatttgtttcttctcttctgtgtttcgatttttgatcaattctttaattttggaagcctataatacagttttctattcttggagataaaaattaaatggatcactgatattttagtcattctgcttctcatctaaatatttccatattctgtattaggagaaaattaccctcccagcaccagcccccctctcaaacccccaacccaaaaccaagcattttggaatgagtctcctttagtttcagagtgtggattgtataacccatatactcttcgatgtacttgtttggtttggtattaatttgactgtgcatgacagcggcaatctttt

SEQ ID NO: 1410 - DNA, 26 bp, Homo sapiens
tttatcataggtctaaaaatatttgt

SEQ ID NO: 1411 - DNA, 31 bp, Homo sapiens
tgctaagtccgctcctgctccaaaaaagggc

SEQ ID NO: 1412 - DNA, 288 bp, Homo sapiens
ggcggcaaagctcgggcaaaagctaaaacgcgttcttccagggccggtcttcagtttccagttggccgtgtgcaccgcctcctccgcaaaggcaactactccgaacgagtcggggccggcgctccagtgtacctggcagcggtgctggaatatctgacggccgagatcttagagctagctggcaacgcggctcgcgacaataagaagacccgcatcatcccgcgccacctgcagctagccatccgcaacgacgaggagctaaataagcttctaggtcgcgtgaccatc

SEQ ID NO: 1413 - DNA, 25 bp, Homo sapiens
acccccccaagacacatatgaccca

SEQ ID NO: 1414 - DNA, 52 bp, Homo sapiens
ccgtcatggcgccccgaaccctcctcctgctactctcgggggccctggccct

SEQ ID NO: 1415 - DNA, 112 bp, Homo sapiens
cagcgacgccgcgagccagaggatggagccgcgggcgccgtggatagagcaggaggggccggagtattgggaccaggagacacggaatgtgaaggcccagtcacagactgac

SEQ ID NO: 1416 - DNA, 26 bp, Homo sapiens
tggggaccctgcgcggctactacaac

SEQ ID NO: 1417 - DNA, 59 bp, Homo sapiens
acggacgggccaggtcgcccacagtctccgggtccgagatccaccccgaagccgcggga

SEQ ID NO: 1418 - DNA, 28 bp, Homo sapiens
tgtgcagcatgagggtctgcccaagccc

SEQ ID NO: 1419 - DNA, 64 bp, Homo sapiens
ggcctggttctccttggagctgtgatcactggagctgtggtcgctgccgtgatgtggaggagga

SEQ ID NO: 1420 - DNA, 174 bp, Homo sapiens
agatttcttgtctcactgagggttccaagccccagctagaaatgtgccctgtctcattactgggaagcaccgtccacaatcatgggcctacccagtctgggccctgtgtgccagcacttactcttttgtaaagcacctgttaaaatgaaggacagatttatcaccttgattacg

SEQ ID NO: 1421 - DNA, 47 bp, Homo sapiens
gcagtgacagtgcccagggctctgatgtgtccctcacagcttgtaaa

SEQ ID NO: 1422 - DNA, 44 bp, Homo sapiens
ttactttctcaaattcttgccatgagaggttgatgagttaatta

SEQ ID NO: 1423 - DNA, 34 bp, Homo sapiens
tgcctcactcccgagctctactgactcccaacag

SEQ ID NO: 1424 - DNA, 234 bp, Homo sapiens
atgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatca

SEQ ID NO: 1425 - DNA, 31 bp, Homo sapiens
actgagagagcccaacgtcctcatctgtttc

SEQ ID NO: 1426 - DNA, 38 bp, Homo sapiens
gtcaatgtcacgtggcttcgaaatggaaaacctgtcac

SEQ ID NO: 1427 - DNA, 127 bp, Homo sapiens
cccagagactacagagaacgtggtgtgtgccctgggcctgactgtgggtctggtgggcatcattattgggaccatcttcatcatcaagggattgcgcaaaagcaatgcagcagaacgcagggggcct

SEQ ID NO: 1428 - DNA, 127 bp, Homo sapiens
atggtgtttcttagagagaagatcactgaagaaacttctgctttaatggctttacaaagctggcaatattacaatccttgacctcagtgaaagcagtcatcttcagcattttccagccctatagcca

SEQ ID NO: 1429 - DNA, 45 bp, Homo sapiens
caccatgcaatgcctctggaataaaacatacaggagtctgtctct

SEQ ID NO: 1430 - DNA, 55 bp, Homo sapiens
tgccccatggggcatctcttgtgtacttattgtttaaggtttcctcaaactgtga

SEQ ID NO: 1431 - DNA, 632 bp, Homo sapiens
aatatatagttcatgtggcgctgcatgaaatcaagaagtgggtgtcttaggataaaagataccaagagtctacaaaaataaccatgtagtaagataaactgctgaacaaaggttttactgttagccaccttctcatgtgttttcttttctctttttctttttctttctttctttcttttttttttttttgagacagagtcttgctctgttacccaggctggagtgcagtggcacgatctcagctcaccgcaacctctgcctcctgggttcaagtgattctcttgcttcagcctcctgagtagctgggattataggcatgcaccactaggcctggctaatttttgtatttttagtagagatggggtttttccatgttggccaggctggtcccgaactcctgacctcaggtgatccgcgcacctcagcctcccaaagtgctgggattacaggcatgagctaccatgcctggccttctcatgtgttttctgattaaggctcttgacttccaaggctgtgtggggagatggggtgggggctcttggactgatataaaactttgtcaaatgtagttctttgaatggagcttgaaacgccgcatattcttgctcccacaaggatagtgggcatcatga

SEQ ID NO: 1432 - DNA, 40 bp, Homo sapiens
agtattctgttacagacctctagtttttagactcttcaat

SEQ ID NO: 1433 - DNA, 120 bp, Homo sapiens
acagacaccctgactgttgaagggaggtttaaaaacagatattcaattgaaatgtaagagagcaccccaattgagagcccaggttacgaagacaagcttgcctcgcctgacttttctgtc

SEQ ID NO: 1434 - DNA, 26 bp, Homo sapiens
ttagaattttggaagccacaaaatag

SEQ ID NO: 1435 - DNA, 185 bp, Homo sapiens
tggctgtttacacccatgaattttggcatgggtatctatttttcttttttacattgaaaaaaatccagtggttgcttttgaatgcatcaagtaaagaagaagaaaagaatacatccgatgcgtagattcttgaccatgtagtaatctataaaattgctatatcctcctgatagccatgggaaaac

SEQ ID NO: 1436 - DNA, 55 bp, Homo sapiens
aagagactgtagcaatacaaaaatcaagcttagtgctttattacctgagttttta

SEQ ID NO: 1437 - DNA, 30 bp, Homo sapiens
gtagcatcctattcttggggagattttctt

SEQ ID NO: 1438 - DNA, 54 bp, Homo sapiens
aaaatttcactgccgaccatccattccttttctttattcggcataattcctcag

SEQ ID NO: 1439 - DNA, 28 bp, Homo sapiens
cacagcaggcatcgcaactttctgcatg

SEQ ID NO: 1440 - DNA, 145 bp, Homo sapiens
catgagtggactaaacctgagaatctcgatttcattgaagttaatgtcagcttgcccaggttcaaactggaagagagttacactctcaactccgacctcgcccgcctaggtgtgcaggatctctttaacagtagcaaggctgatc

SEQ ID NO: 1441 - DNA, 112 bp, Homo sapiens
tttgcatatggctacatcgaggaccttaagtgccgtgtgctggaactgccttaccaaggcgaggagctcagcatggtcatcctgctgccggatgacattgaggacgagtcca

SEQ ID NO: 1442 - DNA, 112 bp, Homo sapiens
ttcgggcatggttgataacatgaccaaacttgtgctagtaaatgccatctatttcaagggaaactggaaggataaattcatgaaagaagccacgacgaatgcaccattcaga

SEQ ID NO: 1443 - DNA, 36 bp, Homo sapiens
gaagatgcaaggaagaccataaaccagtgggtcaaa

SEQ ID NO: 1444 - DNA, 109 bp, Homo sapiens
ctttccatttcaacacggttgaagaggttcattcaagattccagagtctgaatgctgatatcaacaaacgtggagcgtcttatattctgaaacttgctaatagattata

SEQ ID NO: 1445 - DNA, 34 bp, Homo sapiens
ggaccagaggtaacacggcagcacagctgtccaa

SEQ ID NO: 1446 - DNA, 61 bp, Homo sapiens
agcaaacacccgcttcgccttggacctgttcctggcgttgagtgagaacaatccggctgga

SEQ ID NO: 1447 - DNA, 155 bp, Homo sapiens
gagaggccaggctccctcgctcagcttccagcccggcaccccccaccccccaggctcaggcccctcagacccgcagctccctgcgctcgccctccccgccagcttcgcgcccccatcccttccgggcgccccgacggagacagacgacctctgat

SEQ ID NO: 1448 - DNA, 122 bp, Homo sapiens
ttgcacttaggcgacctcgggagctcggactcctacgcagtcaccgggaagggccgccgccccgcccgcggctgctggcccgggtgacgcttccgcctgctataagagcagcggccctcggt

SEQ ID NO: 1449 - DNA, 29 bp, Homo sapiens
tgtgaacacaaataaaattgatttactgt

SEQ ID NO: 1450 - DNA, 503 bp, Homo sapiens
ctgggacttccgaggcaacttgaactcagaacactacagcggagacgccacccggtgcttgaggcgggaccgaggcgcacagagaccgaggcgcatagagaccgaggcacagcccagctggggctaggcccggtgggaaggagagcgtcgttaatttatttcttattgctcctaattaatatttatatgtatttatgtacgtcctcctaggtgatggagatgtgtacgtaatatttattttaacttatgcaagggtgtgagatgttccccctgctgtaaatgcaggtctcttggtatttattgagctttgtgggactggtggaagcaggacacctggaactgcggcaaagtaggagaagaaatggggaggactcgggtgggggaggacgtcccggctgggatgaagtctggtggtgggtcgtaagtttaggaggtgactgcatcctccagcatctcaactccgtctgtctactgtgtgagacttcggcggaccattaggaatg

SEQ ID NO: 1451 - DNA, 49 bp, Homo sapiens
ccctttaatctgacttcggagccctcggactacgctctggacctcagca

SEQ ID NO: 1452 - DNA, 43 bp, Homo sapiens
ctgcctccagaggacgcccctaacgccgcatccctggcgccca

SEQ ID NO: 1453 - DNA, 87 bp, Homo sapiens
ccggcgccagctgccagtcgaggaaccgaacccagccaaaaggcttctctttctgctgctcaccatcgtcttctgccagatcctgat

SEQ ID NO: 1454 - DNA, 33 bp, Homo sapiens
actggggaacgacccgactccagaggcctcgac

SEQ ID NO: 1455 - DNA, 193 bp, Homo sapiens
ctgccacccgaccatgaccatcctgcaggccccgaccccggccccctccaccatcccgggaccccggcggggctccggtcctgagatcttcaccttcgaccctctcccggagcccgcagcggcccctgccgggcgccccagcgcctctcgcgggcaccgaaagcgcagccgcagggttctctaccctcgagtg

SEQ ID NO: 1456 - DNA, 30 bp, Homo sapiens
tgaagtcccagcattgatggcagcgcctca

SEQ ID NO: 1457 - skipped

SEQ ID NO: 1458 - DNA, 29 bp, Homo sapiens
tgatggcagcgcctcatcttcaacttttg

SEQ ID NO: 1459 - skipped

SEQ ID NO: 1460 - DNA, 35 bp, Homo sapiens
ctgcggtggtctccataggcctgatccagaatgga

SEQ ID NO: 1461-1462 - skipped (2 entries)

SEQ ID NO: 1463 - DNA, 26 bp, Homo sapiens
aatgtcctcccttgtggcttcctcag

SEQ ID NO: 1464-1465 - skipped (2 entries)

SEQ ID NO: 1466 - DNA, 31 bp, Homo sapiens
ggaggggttcatagttctccctgagtgagac

SEQ ID NO: 1467 - skipped

SEQ ID NO: 1468 - DNA, 456 bp, Homo sapiens
gtgtgtttcccatgaaccatagtgagacatgcaagagtgaaggtcagcatggggctcttttaggtcctctctgatagggttgtccaaagaggtggagggaacccagcatcaagaagtgggaggtgaagccagattgtgggatgaggaaggagtcacaaatgaccacctggaatacaaaaaaatctacacaagctaaagatgagaagtcagggctatgagaatttctatgggagttcttgaatgctccctctcttattacacacaattactatccagagaaccctgacaccatgtgaaggcagccctatctcataagacagatttctttttttggggaccttggggaaagggaggccagaaacctccgtgtccaaggtggggtggaaggagagggagaaatcttagcaaaaatgtcaaccagcaagggaagatgtgctagcgcaagtaggcaactca

SEQ ID NO: 1469 - DNA, 177 bp, Homo sapiens
aggcacttccatctggtcctaaaccctgcaaacaaaagtgtcaaggcagacctagtgcagagatgagggcatgggggctcagagaggtaaagtgacttgccaaagattgtgaagccagttaagggaaattggggatttttaggacatttgtctcccagaccatttctacagccaata

SEQ ID NO: 1470 - DNA, 280 bp, Homo sapiens
tgttggaaatcgtgtcagttgtaccctgaccataaaatatggtttctattttcataaaacagcattattcacatggcatttccaataatctggattgaaggaagaaaattttatgaaatagctttagataaattaataggccacgttcattttcttgtcaaaaagttactggtggggggatggtgggaaaaagttattagtgcaaatttcctagagaaaaaaccatttctctttcaaattttccagttgaattttatgttcgcttttgcttcttaggttc

SEQ ID NO: 1471 - DNA, 37 bp, Homo sapiens
attatgctcagtattcgatcgggttttctgatttagg

SEQ ID NO: 1472 - DNA, 51 bp, Homo sapiens
tactggagattcctccgacaacatcatgctaactcagtttgtctcaaatga

SEQ ID NO: 1473 - DNA, 60 bp, Homo sapiens
ctcatcagatttatctgccaaacccaaattctcaaagcctttcaacccactgcaaaacaa

SEQ ID NO: 1474 - DNA, 308 bp, Homo sapiens
tagtcagagcactgtttttcctccattttcctccatgggtttctcttccagtaacaaatgtgatccaaagaaatgtaagcatagacatgaaaagggataatgccgcctttaaaactgttttctagtttgttgttagaagttataaaaatacacaggaacacagcattcacttgaaaataaatttttaggcattttaaatagattaaagcagaagaaagagtgagaaagtaaccattctaaattcttaaaaagagaatagcacctatgaaaatgaaataaagaatcatgaataacatcaggaagtcagg

SEQ ID NO: 1475 - DNA, 27 bp, Homo sapiens
tgctttggaatactcttggacagtaag

SEQ ID NO: 1476 - DNA, 375 bp, Homo sapiens
tagccctgtccctcttgattgctgatgtctggtttattgttggtgccacagtggacaccacggtgaacccttctggagtctgcacagctgctgtgttctttacacacttcttctacctctctttgttcttctggatgctcatgcttggcatcctgctggcttaccggatcatcctcgtgttccatcacatggcccagcatttgatgatggctgttggattttgcctgggttatgggtgccctctcattatatctgtcattaccattgctgtcacgcaacctagcaatacctacaaaaggaaagatgtgtgttggcttaactggtccaatggaagcaaaccactcctggcttttgttgtccctgcactggctattg

SEQ ID NO: 1477 - DNA, 265 bp, Homo sapiens
ggacctgtgatatccacggttattcaaaactattccataaatgaagttttcctatttttttccaagatagagtcaaacctgagccagcctcattgtgtgttttgggatttcagtcatttgcagtggaacgatgcaggctgccacctagtgaatgaaactcaagacatcgtgacgtgccaatgtactcacttgacctccttctccatattgatgtcaccttttgtcccctctacaatcttccccgttgtaaaatggatcacctatg

SEQ ID NO: 1478 - DNA, 153 bp, Homo sapiens
ctcaaaaggggttacagctatcagattaaaatgtgtccccaaaatacatctattcccatcagaggccgtgtgttaattgggtcagaccaattccagagatcccttccagaaactattatcagcatggcctcgttgactctggggaacattcta

SEQ ID NO: 1479 - DNA, 147 bp, Homo sapiens
agctgtgtcatccttcgtgcaaaatctttctgtcatcattcggcaaaacccatcaaccacagtggggaatctggcttcggtggtgtcgattctgagcaatatttcatctctgtcactggccagccatttcagggtgtccaattcaac

SEQ ID NO: 1480 - DNA, 59 bp, Homo sapiens
aatgttagttctatatggccaagacatctgatttaaatttgatgaaacacagcatgtca

SEQ ID NO: 1481 - DNA, 1598 bp, Homo sapiens
acttgccctggtcttgagtttcagagtggcaatatcccagtgagcatggctaggtggagggtaagtatacctacgtgcatcattggccagtatgcaaagagcaaggatgacatcagaccctggtgaacccgtggagtcgtgcatgagtggtagcgtctgggcagcagagtctaggttgcagctcaaaagacagagttgatagttttgtcaggcagaggtgttgtggaggagtgtatcattgctgaggaggtctatgatggatggtagagcagcaactaagctggcctcagaagtccagaagacctgggaattaaagagaagagtgaaggtgtgagtcataagccagcaggcttagtacaagtaaggatatatctataccagaaattagggcaaggagtgggtcagacaaaggtgaaccatataaaatgactgaactgcaatggaccttaaggggcatctggtttaccaacctcattttgcagatcagaaaacaaaagaccaaggggccaatagttcctctggtagcaatagttttgaattagaagcatggtcacttgattcctagtccagtgctgtattagtctgttctcacattgttataaagaactatttgagactgggtagtttataaagaaaagaggtttgactcacagttatgcaggatgtacaaaaggcatatctggggaggcctcaggaaacttacaatcatggtgggaggcgaaagggaagtaagcacatccttatatggtgacaggagagagagagagagagagagagagaaagagagagatggagagagaatgggggagatgctacacacttttaaacaaccagatcttgtgagaactgtatcatgagacagcacttgggggatggtgctaaaccattagaaaccacctccatgatccaatcatctcccaccaagccccacctccaacattgggaattataactcgacataagatttgggtggggacacagagccaaaccacatcaggtgctatgccctccacatgatgctctcttaggaaggttcaagtattaagacaagtaagacagaaagaaggaaataaatatctaggaatcagaagaactcaagtcacagaaaagaaggaccccaagaccagttcacagatactgttcagcaagtagatttccatattgagcagaacttctattccagccagagaccttgcttctgctgctgcagtagaaaaccccagaatagtattcatcagaggactgtggaatgtttacttctccctttgtggatctcagtttcctcatctgtaaactggggaaggggattagattctggggtttcttcttgctcttgccttcgttgcctcaattctggacatgagcaatagttgagactagttcgctccaggcagatcccaggtggcttgaacagaaaacagcattgtcagttgagaagaacaagaaggaaaatggcgggcacttgggcgcctgagtggacttaatgttgagtggaaggggactgccttcctttgctgctttccaagttagcctggtgtagtaaaagtagatgggagcctcaagaaagaagtaaaattccaaatctagggccgggtgca

SEQ ID NO: 1482 - DNA, 128 bp, Homo sapiens
ggtccaaggatgatgaatataccctgccctgcagcagtggctacaggggaaacatcacagccaagtgtgagtcctctgggtggcaggtcatcagggagacttgtgtgctctctctgcttgaagaactg

SEQ ID NO: 1483 - DNA, 143 bp, Homo sapiens
agcatcgttgctgggtatgaagttgttggctccagcagtgcatctgaactgctgtcagccattgaacatgttgccgagaaggctaagacagcccttcacaagctgtttccattagaagacggctctttcagagtgttcggaaa

SEQ ID NO: 1484 - DNA, 52 bp, Homo sapiens
ctgtggaacctggtttaacttcactaaatcaaacctataacaagcaggaaaa

SEQ ID NO: 1485 - DNA, 123 bp, Homo sapiens
gcaactacaggagatatgatgcctcataattcggagccagaagtggggctttgggtgagatatctttgcacagataacatgtatacatcatagttcaaaacccagtagtcattgtttacagca

SEQ ID NO: 1486 - DNA, 30 bp, Homo sapiens
aatgtcactcttgtcgcccaagttggagtg

SEQ ID NO: 1487 - DNA, 37 bp, Homo sapiens
gaattcaaggttttgagtcggttcaggtcacccaatt

SEQ ID NO: 1488 - DNA, 82 bp, Homo sapiens
tttggggcactttcaaaattaatgaaaggtttacaaatgaccttttgaattcatcttctgctatatactccaaatatgcaaa

SEQ ID NO: 1489 - DNA, 133 bp, Homo sapiens
gtacctgtgaagacagctacacctggtttcctccctcatgccttgatccccagaactgctaccttcacacggctggagcactcccaagctgtgaatgtcatctcaacaacctcagccagagtgtcaatttctg

SEQ ID NO: 1490 - DNA, 29 bp, Homo sapiens
actgcaacagcctgaatggagtcctgcag

SEQ ID NO: 1491 - DNA, 124 bp, Homo sapiens
cttcaggtgacctatagagattccaaggagaaaagagatttgagaaattttctgaagctcttgaagcctccattattatggtcacatgggctaattagaattatcagagcaaaggctaccacag

SEQ ID NO: 1492 - DNA, 52 bp, Homo sapiens
aatgatggcatcaaaacaaaaaaagaactcattgtgaataagaaaaaacatc

SEQ ID NO: 1493 - DNA, 31 bp, Homo sapiens
tcttcaccttcactgacggccacggtggctt

SEQ ID NO: 1494 - DNA, 26 bp, Homo sapiens
actatgcacccgactgctgctgttca

SEQ ID NO: 1495 - DNA, 97 bp, Homo sapiens
gctcagatactgatactttctttccaaacagcataagaagtgattgagccacaagtatactgaaggaagggctccctcgagttctggtgtgaagaga

SEQ ID NO: 1496 - DNA, 193 bp, Homo sapiens
cttatgctaatatgctctgggctggagaaatgaaatcctcaagccatcaggatttgctatttaagtggcttgacaactgggccaccaaagaacttgaacttcaccttttaggatttgagctgttctggaacacattgctgcactttggaaagtcaaaatcaagtgccagtggcgccctttccatagagaattt

SEQ ID NO: 1497 - DNA, 69 bp, Homo sapiens
atatgtcttgtatagttcatattcatggctgaaacttgaccacactattgctgattgtatggttttcac

SEQ ID NO: 1498 - DNA, 405 bp, Homo sapiens
acatagggatactgcattctggaaattactcaatttagtggcagggtggttttttaattttcttctgtttctgatttttgttgtttggggtgtgtgtgtgtgtttgtgtgtgtgtgtgtgtgtgtgtgtgtgtgtgtgtttaacagagaatatggccagtgcttgagttctttctccttctctctctctcttttttttttaaataactcttctgggaagttggtttataagcctttgccaggtgtaactgttgtgaaatacccaccactaaagttttttaagttccatattttctccattttgccttcttatgtattttcaagattattctgtgcactttaaatttacttaacttaccataaatgcagtgtgacttttcccacacactggattgtgaggctctta

SEQ ID NO: 1499 - DNA, 122 bp, Homo sapiens
gtgacttgcagcctatctttgatgacatgctccactttctaaatcctgaggagctgcgggtgattgaagagattccccaggctgaggacaaactagaccggctattcgaaattattggagtc

SEQ ID NO: 1500 - DNA, 92 bp, Homo sapiens
acaagggcttcttcgtggatgagtcggagccccttctccgctgtgactctacatccagcggctcctccgcgctgagcaggaacggttccttt

SEQ ID NO: 1501 - DNA, 46 bp, Homo sapiens
cccaacgcgaaacttgagaattccgctctcctgacggtggagcctt

SEQ ID NO: 1502 - DNA, 223 bp, Homo sapiens
gatatcctgaagcttgtagcagcccaagtgggaagccagtggaaagatatctatcagtttctttgcaatgccagtgagagggaggttgctgctttctccaatgggtacacagccgaccacgagcgggcctacgcagctctgcagcactggaccatccggggccccgaggccagcctcgcccagctaattagcgccctgcgccagcaccggagaaacgatgttg

SEQ ID NO: 1503 - DNA, 246 bp, Homo sapiens
ggggacatcctagacagaacctacacaagcattttgacatcaatgagcatttgccctggatgattgtgcttttcctgctgctggtgcttgtggtgattgtggtgtgcagtatccggaaaagctcgaggactctgaaaaaggggccccggcaggatcccagtgccattgtggaaaaggcagggctgaagaaatccatgactccaacccagaaccgggagaaatggatctactactgcaatggccatg

SEQ ID NO: 1504 - DNA, 52 bp, Homo sapiens
agaatccaactcttctgcctctgttagaccaaaggtactgagtagcatccag

SEQ ID NO: 1505 - DNA, 142 bp, Homo sapiens
tggtggtgatcaagccggggaccaaggagacagacaacgtctgtggcacactcccgtccttctccagctccacctcaccttcccctggcacagccatctttccacgccctgagcacatggaaacccatgaagtcccttcctc

SEQ ID NO: 1506 - DNA, 266 bp, Homo sapiens
gaaggcctcgaatctcattggcacataccgccatgttgaccgtgccaccggccaggtgctaacctgtgacaagtgtccagcaggaacctatgtctctgagcattgtaccaacacaagcctgcgcgtctgcagcagttgccctgtggggacctttaccaggcatgagaatggcatagagaaatgccatgactgtagtcagccatgcccatggccaatgattgagaaattaccttgtgctgccttgactgaccgagaatgcacttgcc

SEQ ID NO: 1507 - DNA, 37 bp, Homo sapiens
cgagccacagccacgatgatcgcgggctcccttctcc

SEQ ID NO: 1508 - DNA, 130 bp, Homo sapiens
tgcacatggggtgttggaggtagatgggctcccggcccgggaggcggcggtggatgcggcgctgggcagaagcagccgccgattccagctgccccgcgcgccccgggcgcccctgcgagtccccggttca

SEQ ID NO: 1509 - DNA, 29 bp, Homo sapiens
gtgctgagcgcccctagagcctcccttgc

SEQ ID NO: 1510 - DNA, 89 bp, Homo sapiens
ctggaagcttcgctatgggaagtcgttcctttgctctctcgcgcccagtcctcctccctggttctcctcagccgctgtcggaggagagc

SEQ ID NO: 1511 - DNA, 730 bp, Homo sapiens
acgcattacacaccgagtagggctatgtagagaggagtcagattatctacttagatttggcatctacttagatttaacatatactagctgagaaattgtaggcatgtttgatacacatttgatttcaaatgtttttcttctggatctgctttttattttacaaaaatatttttcatacaaatggttaaaaagaaacaaaatctataacaacaactttggatttttatatataaactttgtgatttaaatttactgaatttaattagggtgaaaattttgaaagttgtattctcatatgactaagttcactaaaaccctggattgaaagtgaaaattatgttcctagaacaaaatgtacaaaaagaacaatataattttcacatgaacccttggctgtagttgcctttcctagctccactctaaggctaagcatcttcaaagacgttttcccatatgctgtcttaattcttttcactcattcacccttcttcccaatcatctggctggcatcctcacaattgagttgaagctgttcctcctaaaacaatcctgacttttattttgccaaaatcaatacaatcctttgaattttttatctgcataaattttacagtagaatatgatcaaaccttcatttttaaacctctcttctctttgacaaaacttccttaaaaaagaatacaagataatataggtaaataccctccactcaaggaggtagaactcagtc

SEQ ID NO: 1512 - DNA, 35 bp, Homo sapiens
cagttgcaaggcctcctgcaattgttcaaacagca

SEQ ID NO: 1513 - DNA, 56 bp, Homo sapiens
tgaacaaggagcaccttgtgccagttgcccagataactgtgacgatggactatgca

SEQ ID NO: 1514 - DNA, 69 bp, Homo sapiens
gcagcaaatgcccaaaagtgggcaaaccagtgcaattacagacacagtaacccaaaggatcgaatgaca

SEQ ID NO: 1515 - DNA, 71 bp, Homo sapiens
acccaaacacaagtgcaaagggagattgtgaataagcacaatgaactgaggagagcagtatctccccctgc

SEQ ID NO: 1516 - DNA, 25 bp, Homo sapiens
ccagtgctgttgttcctggttgctg

SEQ ID NO: 1517 - DNA, 26 bp, Homo sapiens
gcagatccctgttccaccggttttgt

SEQ ID NO: 1518 - DNA, 25 bp, Homo sapiens
cttcatcctgctctggaaaccactg

SEQ ID NO: 1519 - DNA, 42 bp, Homo sapiens
agacctgtgttcacaaagatggctgtctggggcaacaagtag

SEQ ID NO: 1520 - DNA, 938 bp, Homo sapiens
agccagacatgctaagtggcacttactgctgattgtaacaaagaagtaatatatcaaggtctttccatgttcacacaaggtagcttgtgtgtaataacttagcttcaaaaccatagactgcagaactcacaagttcaacagcctttccttttttaaggaaatgaaaacaatggaaaatatagtcatcataacttaattcggtttattttttttttctgtaaactccccctgaaagacattcctattaatacagtaaatgtgaacactgacttgtttttataagcacatctgaaagggcatatttgagtctcatcccaactttggtccttgctatctgtgcaggcttgggcaggtcatctccctgctggtctcaatatcctcacctgtaaaatgattgtaaatgatccccctaccttcaagattctctgattgatagaattttttctttaattaaaaaattttaaatattccttgagttggaagcactgatcaataagtggattgcttagggaggttggaacgaatagattcagtcccaacttcctcttttaaattccctcttcctcactcttcctgcaacacttatttttacagttgagttttaaaaataagtaatatataaaataatttctgtagtgtggtttcagatttaaaaattcctgcagacaggctgggcttgcaaccccatcagtcgatggtcagagccctttgctttttgagaccatttttaggtgagcttggcttgcctggatacagtgtgcagtgcattcttcctgaattttgcaattctggtatctgggtgtattttctaggtgtgtcagggtgagtgtaatccacctagggtgtggaaaaagccaagaaagggaaattaaaagaggttcctatccagtcatgttaatgatcttccacttgtactatcctgtgcttcgttgttaacc

SEQ ID NO: 1521 - DNA, 256 bp, Homo sapiens
tgtgcagtgtagctgaagcctcctccttgtgctggggtccccttccattcaggtggtggggtagcagtctctctattttccccttgccctccttcccattttatcatttgttattttttttcccaccataagtcatatgttacttccactatggtgtatgtcattgtgaggatgggtgcagagaggctgggtgggagaacggaaatatatctccctagggctactgttggccagctagtccttggcagtgaatttt

SEQ ID NO: 1522 - DNA, 53 bp, Homo sapiens
tatatatgatgcatcggataggtcattatgattttttaccatttcgacttaca

SEQ ID NO: 1523 - DNA, 303 bp, Homo sapiens
gctaaggcttcatgttgactcgatatgtcatctaggaaagtactatttcatggtccaaacctgttgccatagttggtaaggctttcctttaagtgtgaaatatttagatgaaattttctcttttaaagttctttatagggttagggtgtgggaaaatgctatattaataaatctgtagtgttttgtgtttatatgttcagaaccagagtagactggattgaaagatggactgggtctaatttatcatgactgatagatctggttaagttgtgtagtaaagcattaggagggtcattcttgtca

SEQ ID NO: 1524 - DNA, 27 bp, Homo sapiens
tttctccaggcgactttgaacccattt

SEQ ID NO: 1525 - DNA, 26 bp, Homo sapiens
ttcatgccaaccctgctgtcacttac

SEQ ID NO: 1526 - DNA, 90 bp, Homo sapiens
tcatcatcctggtgatctgtttcatcctctccttcttcgccctctgtggaccccagatgcttgtcttcctgagagtgattggaggtctcc

SEQ ID NO: 1527 - DNA, 26 bp, Homo sapiens
cagcgggtcctacgaggagggctgtc

SEQ ID NO: 1528 - DNA, 32 bp, Homo sapiens
cacggccagacgtcctcgctgtggtggaaatg

SEQ ID NO: 1529 - DNA, 86 bp, Homo sapiens
ccgcggcctcttcgcttttgtggcggcgcccgcgctcgcaggccactctctgctgtcgcccgtcccgcgcgctcctccgacccgct

SEQ ID NO: 1530 - DNA, 223 bp, Homo sapiens
gtgttgtggggtcaaccgtacaatggtgtgggagtgacgatgatgtgagtatttagaatgtaccatattttttgtaaattatttatgtttttctaaacaaatttatcgtataggttgatgaaacgtcatgtgttttgccaaagactgtaaatatttatttatgtgttcacatggtcaaaatttcaccactgaaaccctgcacttagctagaacctcattttta

SEQ ID NO: 1531 - DNA, 564 bp, Homo sapiens
tcacgatgaagcatgctagaagctgtaacagaatacatagagaataatgaggagtttatgatggaaccttaaatatataatgttgccagcgattttagttcaatatttgttactgttatctatctgctgtatatggaattcttttaattcaaacgctgaaaagaatcagcatttagtcttgccaggcacacccaataatcagtcatgtgtaatatgcacaagtttgtttttgtttttgttttttttgttggttggtttgtttttttgctttaagttgcatgatctttctgcaggaaatagtcactcatcccactccacataaggggtttagtaagagaagtctgtctgtctgatgatggatagggggcaaatctttttcccctttctgttaatagtcatcacatttctatgccaaacaggaacaatccataactttagtcttaatgtacacattgcattttgataaaattaattttgttgtttcctttgaggttgatcgttgtgttgttgttttgctgcactttttacttttttgcgtgtggagctgtattcccgagaccaacg

SEQ ID NO: 1532 - DNA, 252 bp, Homo sapiens
catccttgcaaatgggtgtgacgcggttccagatgtggatttggcaaaacctcatttaagtaaaaggttagcagagcaaagtgcggtgctttagctgctgcttgtgccgctgtggcgtcggggaggctcctgcctgagcttccttccccagctttgctgcctgagaggaaccagagcagacgcacaggccggaaaaggcgcatctaacgcgtatctaggctttggtaactgcggacaagttgcttttacctg

SEQ ID NO: 1533 - DNA, 206 bp, Homo sapiens
tgggcatgccattacattgctttttcttgtttgtttaaaaagaatgacgtttacatataaaatgtaattacttattgtatttatgtgtatatggagttgaagggaatactgtgcataagccattatgataaattaagcatgaaaaatattgctgaactacttttggtgcttaaagttgtcactattcttgaattagagttgctcta

SEQ ID NO: 1534 - DNA, 36 bp, Homo sapiens
tcctgtcccttgaccttaactctgatggttcttcac

SEQ ID NO: 1535 - DNA, 35 bp, Homo sapiens
atgccatggtccctagacacctcagttcattgtgg

SEQ ID NO: 1536 - DNA, 108 bp, Homo sapiens
cagactcaggacctatctatgaccaaacctacgctggcgggcggctgggtctatttgtcttctctcaagaaatggtctatttctcagacctcaagtacgaatgcagag

SEQ ID NO: 1537 - DNA, 95 bp, Homo sapiens
tgcgaaccttatggcacgaccccaggaacattggctggaaggactacacggcctataggtggcacctgactcacaggcccaagactggctacatc

SEQ ID NO: 1538 - DNA, 84 bp, Homo sapiens
ttcagtggcacattctacgtaaacactgaccgggacgacgactatgccggcttcgtctttggttaccagtcaagcagccgcttc

SEQ ID NO: 1539 - DNA, 212 bp, Homo sapiens
tgatggacggggtgatatttgtaaagatgattttgacaatgacaacatcccagatattgatgatgtgtgtcctgaaaacaatgccatcagtgagacagacttcaggaacttccagatggtccccttggatcccaaagggaccacccaaattgatcccaactgggtcattcgccatcaaggcaaggagctggttcagacagccaactcggacc

SEQ ID NO: 1540 - DNA, 63 bp, Homo sapiens
tgtcttcaatgaacgagacaattgtccctacgtctacaacactgaccagagggacacggatgg

SEQ ID NO: 1541 - DNA, 137 bp, Homo sapiens
ttcaatccccgccaggctgactatgacaaggatgaggttggggaccgctgtgacaactgcccttacgtgcacaaccctgcccagatcgacacagacaacaatggagagggtgacgcctgctccgtggacattgatgg

SEQ ID NO: 1542 - DNA, 32 bp, Homo sapiens
acaaggacgggattggcgatgcctgtgatgat

SEQ ID NO: 1543 - DNA, 178 bp, Homo sapiens
tgagcccgaaaacccatgcaaggacaagacacacaactgccacaagcacgcggagtgcatctacctgggccacttcagcgaccccatgtacaagtgcgagtgccagacaggctacgcgggcgacgggctcatctgcggggaggactcggacctggacggctggcccaacctcaatctg

SEQ ID NO: 1544 - DNA, 109 bp, Homo sapiens
tccaccagcaaggtgcctcgctgtgtcaacactcagcctggcttccactgcctgccctgcccgccccgatacagagggaaccagcccgtcggggtcggcctggaagcag

SEQ ID NO: 1545 - DNA, 179 bp, Homo sapiens
tgaaacccgggcttccattctgatgaaaagcacaaacgctttgggaaactagatgaaaaacacagaaaagaaaaatcaattttagttgcacacgcaaagataactacttttaacatctgtgtttcagtcctcctgtatttctaatgtaaaaacaaaaaagatgccaggtggcgtggcct

SEQ ID NO: 1546 - DNA, 138 bp, Homo sapiens
ggtccccgtggtcggcctgcactgtcacctgtgccggtgggatccgggagcgcacccgggtctgcaacagccctgagcctcagtacggagggaaggcctgcgtgggggatgtgcaggagcgtcagatgtgcaacaaga

SEQ ID NO: 1547 - DNA, 84 bp, Homo sapiens
tctgtgacctgtggagttggcaatatcacacgcatccgtctctgcaactccccagtgccccagatggggggcaagaattgcaaa

SEQ ID NO: 1548 - DNA, 30 bp, Homo sapiens
tccggcaggacggcggctggagccactggt

SEQ ID NO: 1549 - DNA, 35 bp, Homo sapiens
aaatacccctctaggcggcacagcctgatctctct

SEQ ID NO: 1550 - DNA, 129 bp, Homo sapiens
tggacccagtgctccgtgacgtgtggctctgggacccagcagagaggccggtcctgtgacgtcaccagcaacacctgcttggggccctccatccagacacgggcttgcagtctgagcaagtgtgacacc

SEQ ID NO: 1551 - DNA, 84 bp, Homo sapiens
aaaccatttgccaccaaatcacctgcccgcctgcaacctgcgccagtccatcctttgtggaaggcgaatgctgcccttcctgcc

SEQ ID NO: 1552 - DNA, 111 bp, Homo sapiens
tcattggtggccctcctaagacaaggaacatgtcagcttgctggcaggatggccggttctttgcggaaaatgaaacgtgggtggtggacagctgcaccacgtgtacctgca

SEQ ID NO: 1553 - DNA, 146 bp, Homo sapiens
tccgcatgtcaccaccgagtacgtgggccccagctcggagaggaggcccgaggtgtgcgaacgctcgtgcgaggagctgggaaacatggtccaggagctctcggggctccacgtcctcgtgaaccagctcagcgagaacctcaaga

SEQ ID NO: 1554 - DNA, 87 bp, Homo sapiens
aaatgcattttatatactggcttggatggatttctattgtgacatggtgtatgtgtgtgtgtgtatgtgtgtgcattcatgcttgta

SEQ ID NO: 1555 - DNA, 75 bp, Homo sapiens
gcttcagaacgtccacctagtgtttgaaaactctgtggaagatattctaagcaagaagggttgccagcaaggcca

SEQ ID NO: 1556 - DNA, 227 bp, Homo sapiens
cgcttcgtgcgctttgactacatcccaccggtgaacgcagatgacctcagcaagatcaccaagatcatgcggcagaaggagggcttcttcctcacggcccagctcaagcaggacggcaagtccaggggcacgctgttggctctggagggccccggtctctcccagaggcagttcgagatcgtctccaacggccccgcggacacgctggatctcacctactggattga

SEQ ID NO: 1557 - DNA, 51 bp, Homo sapiens
tggtctggaggctggtcctgctggctctgtgggtgtggcccagcacgcaag

SEQ ID NO: 1558 - DNA, 95 bp, Homo sapiens
ccctggtgaagtttcatttgccgaattcatctctcatgacaacccgatgaggtgggcattttacatgacgctacgtttcattctacggatgagga

SEQ ID NO: 1559 - DNA, 167 bp, Homo sapiens
cctgcacaggagaagcggcatataaagccgcgctgcccgggagccgctcggccacgtccaccggagcatcctgcactgcagggccggtctctcgctccagcagagcctgcgcctttctgactcggtccggaacactgaaaccagtcatcactgcatctttttggcaa

SEQ ID NO: 1560 - DNA, 47 bp, Homo sapiens
gagacggcatccagtacagaggggctggacttggacccctgcagcag

SEQ ID NO: 1561 - DNA, 544 bp, Homo sapiens
tcccgtcgacgctctgttccgagagcgtgccccggaccgccagctcagaacaggggcagccgtgtagccgaacggaagctgggagcagccgggactggtggcccgcgcccgagctccgcaggcgggaagcaccctggatttaggaagtcccgggagcagcgcggcggcacctccctcacccaaggggccgcggcgacggtcacggggcgcggcgccaccgtgagcgacccaggccaggattctaaatagacggcccaggctcctcctccgcccgggccgcctcacctgcgggcattgccgcgccgcctccgccggtgtagacggcacctgcgccgccttgctcgcgggtctccgcccctcgcccaccctcactgcgccaggcccaggcagctcacctgtactggcgcgggctgcggaagcctgcgtgagccgaggcgttgaggcgcggcgcccacgccactgtcccgagaggacgcaggtggagcgggcgcggcttcgcggaacccggcgccggccgccgcagtggtcccagcctacaccgggt

SEQ ID NO: 1562 - DNA, 132 bp, Homo sapiens
gtcaaatccttccaagcggcatagagaccgacttaatacagagttggaccgtttggctagcctgctgcctttcccacaagatgttattaataagttggacaaactttcagttcttaggctcagcgtcagtta

SEQ ID NO: 1563 - DNA, 50 bp, Homo sapiens
aggataactgtagagcagcaaatttcagagaaggcctgaacttacaagaa

SEQ ID NO: 1564 - DNA, 87 bp, Homo sapiens
tctgaatggctttgtattagttgtcactacagatgctttggtcttttatgcttcttctactatacaagattatctagggtttcagca

SEQ ID NO: 1565 - DNA, 29 bp, Homo sapiens
atcagtccttttgttgtattccttgtatc

SEQ ID NO: 1566 - DNA, 82 bp, Homo sapiens
accgaagaccgagctgaatttcagcgtcagctacactgggcattaaatccttctcagtgtacagagtctggacaaggaattg

SEQ ID NO: 1567 - DNA, 97 bp, Homo sapiens
agacagtagtctgttataacccagaccagattcctccagaaaactctcctttaatggagaggtgcttcatatgtcgtctaaggtgtctgctggataa

SEQ ID NO: 1568 - DNA, 87 bp, Homo sapiens
tttaggatatactgaagcagagctgtgcacgagaggctcaggttatcagtttattcatgcagctgatatgctttattgtgccgagtc

SEQ ID NO: 1569 - DNA, 87 bp, Homo sapiens
aaccgatggacttgggtccagtctaatgcacgcctgctttataaaaatggaagaccagattatatcattgtaactcagagaccacta

SEQ ID NO: 1570 - DNA, 211 bp, Homo sapiens
ataagtcctcttatgtgaaagcataaaaataattcaagcagactttagtctgtaaataaaaattgaaaagtttaattcatctagaaagaagagcacaggtgagagacattgagaagatagaattgacgaacttgattgagagctacatgtgcagagctatagaaagaataataaaactctagggttttatcttgggcatatgaaagacaca

SEQ ID NO: 1571 - DNA, 99 bp, Homo sapiens
aggaaggaacagagcatttacgaaaacgaaatacgaagttgccttttatgtttaccactggagaagctgtgttgtatgaggcaaccaacccttttcctg

SEQ ID NO: 1572 - DNA, 340 bp, Homo sapiens
tgcaccgatgggaaatgatactatcctgaaacatgagcaaattgaccagcctcaggatgtgaactcatttgctggaggtcacccagggctctttcaagatagtaaaaacagtgacttgtacagcataatgaaaaacctaggcattgattttgaagacatcagacacatgcagaatgaaaaatttttcagaaatgatttttctggtgaggttgacttcagagacattgacttaacggatgaaatcctgacgtatgtccaagattctttaagtaagtctcccttcataccttcagattatcaacagcaacagtccttggctctgaactcaagctgtatggta

SEQ ID NO: 1573 - DNA, 67 bp, Homo sapiens
tgaagcacatgcaagttaatggcatgtttgaaaattggaactctaaccaattcgtgcctttcaattg

SEQ ID NO: 1574 - DNA, 234 bp, Homo sapiens
tgtacagagctggactaccctatggggagttttgaaccatccccataccccactacttctagtttagaagattttgtcacttgtttacaacttcctgaaaaccaaaagcatggattaaatccacagtcagccataataactcctcagacatgttatgctggggccgtgtcgatgtatcagtgccagccagaacctcagcacacccacgtgggtcagatgcagtacaatccagta

SEQ ID NO: 1575 - DNA, 80 bp, Homo sapiens
gaaacatatccagctgaattaaataacataaataacactcagactaccacacatcttcagccacttcatcatccgtcaga

SEQ ID NO: 1576 - DNA, 490 bp, Homo sapiens
aaactgtcactgttggacgtcagcaagttcacatggaggcattgatgcatgctattcacaattattccaaaccaaattttaatttttgcttttagaaaagggagtttaaaaatggtatcaaaattacatatactacagtcaagatagaaagggtgctgccacggagtggtgaggtaccgtctacatttcacattattctgggcaccacaaaatatacaaaactttatcagggaaactaagattcttttaaattagaaaatattctctatttgaattatttctgtcacagtaaaaataaaatactttgagttttgagctactggattcttattagttccccaaatacaaagttagagaactaaactagtttttcctatcatgttaacctctgcttttatctcagatgttaaaataaatggtttggtgctttttataaaaagataatctcagtgctttcctccttcactgtttcatctaagtgcctcacatt

SEQ ID NO: 1577 - DNA, 709 bp, Homo sapiens
gttgctatgtgccttatgttgaaaaaatttaaaagtaaaatgtctttccaaattatttcttaattattataaaaatattaagacaatagcacttaaattcctcaacagtgttttcagaagaaataaatataccactctttacctttattgatatctccatgatgatagttgaatgttgcaatgtgaaaaatctgctgttaactgcaaccttgtttattaaattgcaagaagctttatttctagctttttaattaagcaaagcacccatttcaatgtgtataaattgtctttaaaaactgttttagacctataatccttgataatatattgtgttgactttataaatttcgcttcttagaacagtggaaactatgtgtttttctcatatttgaggagtgttaagattgcagatagcaaggtttggtgcaaagtattgtaatgagtgaattgaatggtgcattgtatagatataatgaacaaaattatttgtaagatatttgcagtttttcattttaaaaagtccataccttatatatgcacttaatttgttggggctttacatactttatcaatgtgtctttctaagaaatcaagtaatgaatccaactgcttaaagttggtattaataaaaagacaaccacatagttcgtttaccttcaaactttaggtttttttaatgatatactgatcttcattaccaataggcaaa

SEQ ID NO: 1578 - DNA, 70 bp, Homo sapiens
tatgagagctgaagagcttagacacattttgcatgtattatttgaaaatctgatggaatcccaaactgag

SEQ ID NO: 1579 - DNA, 26 bp, Homo sapiens
gaatagcctgaacctgggaatcggag

SEQ ID NO: 1580 - DNA, 237 bp, Homo sapiens
atggcttcggacaaaatatctctgagttctgtgtattttcagtcaaaactttaaacctgtagaatcaatttaagtgttggaaaaaatttgtctgaaacatttcataatttgtttccagcatgaggtatctaaggatttagaccagaggtctagattaatactctatttttacatttaaaccttttattataagtcttacataaaccatttttgttactctcttccacatgttactgg

SEQ ID NO: 1581 - DNA, 37 bp, Homo sapiens
aactaaaatgtatctaagaataataaaatcacgttaa

SEQ ID NO: 1582 - DNA, 200 bp, Homo sapiens
cgtttgtctgtattgttaagtgccaaacaaaggatacttagtgcactgctacattgtgggatttatttctagatgatgtgcacatctaaggatatggatgtgtctaatttagtcttttcctgtaccaggtttttcttacaatacctgaagacttaccagtattctagtgtattatgaagctttcaacattactatgcaca

SEQ ID NO: 1583 - DNA, 286 bp, Homo sapiens
tatgcagacaacgagtcagagtttccccttgaaagcctcaaaagtgtccacgtcctcaaaaagaatggaaccaatttaagaagccagccccgtggccacgtcccttcccccattcgctccctcctctgcgcccccgcaggctcctcccagctgtggctgcccgggcccccagccccagccctcccattggtggaggcccttttggaggcaccctagggccagggaaacttttgccgtataaatagggcagatccgggctttattattttagcaccacggcagcagg

SEQ ID NO: 1584 - DNA, 65 bp, Homo sapiens
gtgatacctccgccggtgacccaggggctctgcgacacaaggagtctgcatgtctaagtgctaga

SEQ ID NO: 1585 - DNA, 30 bp, Homo sapiens
ggcccagccggagatagaggaccacgtgga

SEQ ID NO: 1586 - DNA, 26 bp, Homo sapiens
agatggtcccacaggccctcctggtc

SEQ ID NO: 1587 - DNA, 30 bp, Homo sapiens
ggcttaatgggacctagaggcccacctggt

SEQ ID NO: 1588 - DNA, 27 bp, Homo sapiens
gccctcaaggtttccaaggacctgctg

SEQ ID NO: 1589 - DNA, 25 bp, Homo sapiens
gtgagcctggtgaacctggtcaaac

SEQ ID NO: 1590 - DNA, 33 bp, Homo sapiens
tctggatggattgaagggacagcccggtgctcc

SEQ ID NO: 1591 - DNA, 25 bp, Homo sapiens
cctggtgagagaggacgtgttggtg

SEQ ID NO: 1592 - DNA, 25 bp, Homo sapiens
ggtgcccgtggcagtgatggaagtg

SEQ ID NO: 1593 - DNA, 30 bp, Homo sapiens
ggtcccattgggtctgctggccctccaggc

SEQ ID NO: 1594 - DNA, 71 bp, Homo sapiens
aaattggagctgttggtaacgctggtcctgctggtcccgccggtccccgtggtgaagtgggtcttccaggc

SEQ ID NO: 1595 - DNA, 39 bp, Homo sapiens
gtaatcctggagcaaacggccttactggtgccaagggtg

SEQ ID NO: 1596 - DNA, 64 bp, Homo sapiens
ctccctggaccccgcggtattcctggccctgttggtgctgccggtgctactggtgccagaggac

SEQ ID NO: 1597 - DNA, 28 bp, Homo sapiens
gccctaatggggaagctggatctgccgg

SEQ ID NO: 1598 - DNA, 28 bp, Homo sapiens
ggtagtcctggttctcgtggtcttcctg

SEQ ID NO: 1599 - DNA, 97 bp, Homo sapiens
ggccctcctggtagtcgtggtgcaagtggccctgctggagtccgaggacctaatggagatgctggtcgccctggggagcctggtctcatgggaccca

SEQ ID NO: 1600 - DNA, 32 bp, Homo sapiens
tcccctggaaatatcggccccgctggaaaaga

SEQ ID NO: 1601 - DNA, 78 bp, Homo sapiens
tccctggcatcgacggcaggcctggcccaattggcccagctggagcaagaggagagcctggcaacattggattccctg

SEQ ID NO: 1602 - DNA, 35 bp, Homo sapiens
ggtgatcctggcaaaaacggtgataaaggtcatgc

SEQ ID NO: 1603 - DNA, 42 bp, Homo sapiens
tccaggtcctgatggaaacaatggtgctcagggacctcctgg

SEQ ID NO: 1604 - DNA, 34 bp, Homo sapiens
cctcaggtcccgctggtgaagttggcaaaccagg

SEQ ID NO: 1605 - DNA, 26 bp, Homo sapiens
ggtctccatggtgagtttggtctccc

SEQ ID NO: 1606 - DNA, 58 bp, Homo sapiens
tgagagtggtgctgccggtcctactggtcctattggaagccgaggtccttctggaccc

SEQ ID NO: 1607 - DNA, 132 bp, Homo sapiens
ctgcctggaataagtagaccctttacaatagaaagataattgtttttcagatttttatttatttccagttctgtgatgacttccctctcagtaaacagcaatccgattccagtggacctgaattattctaaa

SEQ ID NO: 1608 - DNA, 160 bp, Homo sapiens
gaatcgcagctgtgcactcccactaccctcatctcttcagtcaccatgtcattaacagcatctctctctgctatattctccctcctttcaatagcccagccttctttgtgtttcaaagcaggcaagaagcctgtctagctagctgtttaaattggaattc

SEQ ID NO: 1609 - DNA, 84 bp, Homo sapiens
ggttggtgctgtgggcactgctggtccatctggtcctagtggactcccaggagagaggggtgctgctggcatacctggaggcaa

SEQ ID NO: 1610 - DNA, 45 bp, Homo sapiens
ggtgaacctggtctcagaggtgaaattggtaaccctggcagagat

SEQ ID NO: 1611 - DNA, 25 bp, Homo sapiens
agacatgtttcctttttggtactag

SEQ ID NO: 1612 - DNA, 47 bp, Homo sapiens
tcctggtgctgtaggtgcccctggtcctgctggagccacaggtgacc

SEQ ID NO: 1613 - DNA, 47 bp, Homo sapiens
ggtgaacgtggtgaggtcggtcctgctggccccaatggatttgctgg

SEQ ID NO: 1614 - DNA, 103 bp, Homo sapiens
tgctgctggtcaacctggtgctaaaggagaaagaggagccaaagggcctaagggtgaaaacggtgttgttggtcccacaggccccgttggagctgctggccca

SEQ ID NO: 1615 - DNA, 230 bp, Homo sapiens
tatatccgtcaagtgcctgctatgcaacagggaatataccagatagaagatggaaaataacggaaggattaacatttgcacactgctttacaaagtataaaagtttcatgaatattgttttattttaattctctgataacctcataagggtggtaatattgaagaacattctgacacagatagtcattttttatttctatattttcttctaagagatgcgggaatgatcc

SEQ ID NO: 1616 - DNA, 36 bp, Homo sapiens
ccaaatggtccccccggtcctgctggaagtcgtggt

SEQ ID NO: 1617 - DNA, 194 bp, Homo sapiens
ttacaatggactctcgccgcttttcttttttcagaatctattaaggacacttgaaagttttgaaatttttggtaaatttggactaccatgaggaaacttttgagattcaagttcattctattcagagcaattccgatattgatgttaacttgaactcagctggaactcagtgtatgttgctatcagctcacttg

SEQ ID NO: 1618 - DNA, 32 bp, Homo sapiens
tggtgctgctggacggactggtcccccaggac

SEQ ID NO: 1619 - DNA, 105 bp, Homo sapiens
aaagaagggcttcgtggtcctcgtggtgaccaaggtccagttggccgaactggagaagtaggtgcagttggtccccctggcttcgctggtgagaagggtccctct

SEQ ID NO: 1620 - DNA, 260 bp, Homo sapiens
agccaggaaatctgtccagcacacactgaggggctgtggcttccaagatgctcagaaagcacaaaatcgggaagacaataaatgagggaactcagttttatcacaaagcccttaaagctattgaaggcaccttactggtaccaggattagaacagagtcccattgctgtggccatcctactacatattaatcaatctcagtaggctaccaatttcttaaacatacactgtccagtattagtgctactctgaaaggtgccc

SEQ ID NO: 1621 - DNA, 36 bp, Homo sapiens
ggtctccctggctcgagaggtgaacgtggtctacca

SEQ ID NO: 1622 - DNA, 217 bp, Homo sapiens
tgggatactgaatgacacgaggctcactttttacagagcaacatcccgtgattacataaagctggccatctacatgtggagaaggagggcagagatgatactaatgatacttcttaccattgtgtgacccattcacattcaatttaccttcttccttcaaactagaatctcctgagtagggttgttttggaggggaaggttagcattccatcgaata

SEQ ID NO: 1623 - DNA, 89 bp, Homo sapiens
gtcctcttggcattgccggccctcctggggcccgtggtcctcctggtgctgtgggtagtcctggagtcaacggtgctcctggtgaagct

SEQ ID NO: 1624 - DNA, 102 bp, Homo sapiens
agagcgcggttaccctggcaatattggtcccgttggtgctgcaggtgcacctggtcctcatggccccgtgggtcctgctggcaaacatggaaaccgtggtga

SEQ ID NO: 1625 - DNA, 103 bp, Homo sapiens
acaaggcattcgtggcgataagggagagcccggtgaaaaggggcccagaggtcttcctggcttaaagggacacaatggattgcaaggtctgcctggtatcgct

SEQ ID NO: 1626 - DNA, 281 bp, Homo sapiens
ctgtagccatctcgcacataaactgatcctgaaggccttcagctcagaaggattttcatattttcactgctattgttccagtatagcctatataatatccatttcccattctctggctaactccatctcactcttggaggtaatgctatttcataccaacatgaaaggtgaggattaagggagatagaaatagacatacaataaaatctcctggtaacaatgtccttcaaccccacttaaaataaacataattagaggaatgactaatattgcactgctga

SEQ ID NO: 1627 - DNA, 26 bp, Homo sapiens
ccatggtgatcaaggtgctcctggct

SEQ ID NO: 1628 - DNA, 75 bp, Homo sapiens
gatggtcgcactggacatcctggtacagttggacctgctggcattcgaggccctcagggtcaccaaggccctgct

SEQ ID NO: 1629 - DNA, 267 bp, Homo sapiens
gatcacggacctaaggaatgttttcttcagactaaaccaagacaactttgacaacccattaaagttagccccatttcaatatatcctctaaaatatctggaaattgtctatatgcaatgggcttgttaagtccatccctgcaagtgtgcctgggggctcgttatttatttatgtgaacttgattattttttactgatgagaacatgcttccgtgtgaagctcaactgaaaatctgctgccatggatgtctctcactgtaacaaaata

SEQ ID NO: 1630 - DNA, 180 bp, Homo sapiens
actttggttacgatggagacttctacagggctgaccagcctcgctcagcaccttctctcagacccaaggactatgaagttgatgctactctgaagtctctcaacaaccagattgagacccttcttactcctgaaggctctagaaagaacccagctcgcacatgccgtgacttgagactca

SEQ ID NO: 1631 - DNA, 161 bp, Homo sapiens
ccaaggatgcactatggatgctatcaaagtatactgtgatttctctactggcgaaacctgtatccgggcccaacctgaaaacatcccagccaagaactggtataggagctccaaggacaagaaacacgtctggctaggagaaactatcaatgctggcagcc

SEQ ID NO: 1632 - DNA, 68 bp, Homo sapiens
ggagtgacttccaaggaaatggctacccaacttgccttcatgcgcctgctggccaactatgcctctca

SEQ ID NO: 1633 - DNA, 32 bp, Homo sapiens
ttgcatacatggatgaggagactggcaacctg

SEQ ID NO: 1634 - DNA, 84 bp, Homo sapiens
gctgtcattctacagggctctaatgatgttgaacttgttgctgagggcaacagcaggttcacttacactgttcttgtagatggc

SEQ ID NO: 1635 - DNA, 413 bp, Homo sapiens
ttcttgagacttcagtggcctaaactataatttatagttatgtgtattttattttacttattagtatggcctacatttaacttttaatgctttttctacaatatgctataaatataagaaaaattaaaattcactaacagcaagactacatacccacccaggtcccgctcccaaagacacacatagagggacatacacacaacaatcctaaaaatgactttgtagagataggtcacttggaatgtgtgttgaaatgttgttggtttttttggtttgtttgtttgtttgttttttgttagactgatagggagcccctcccactaaagacacccttgatactgttatttcaaggatgaacttatttatctgggacagacatcttcagaatgacacatgccaaacagtggttctta

SEQ ID NO: 1636 - DNA, 111 bp, Homo sapiens
ggggaaagacaatcattgaatacaaaacaaataagccatcacgcctgcccttccttgatattgcacctttggacatcggtggtgctgaccaggaattctttgtggacattg

SEQ ID NO: 1637 - DNA, 70 bp, Homo sapiens
acatctacttgcttaaattgtgggcaaaagagaaaaagaaggattgatcagagcattgtgcaatacagtt

SEQ ID NO: 1638 - DNA, 29 bp, Homo sapiens
ttcaacactcttacacctgttatggaaaa

SEQ ID NO: 1639 - DNA, 343 bp, Homo sapiens
tttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaatcttcttcagattcagcatttgttctttgccagtctcattttcatcttcttccatggttccacagaagctttgtttcttg

SEQ ID NO: 1640 - DNA, 100 bp, Homo sapiens
gagccgagtggagggcgcgagccagatgcggggcgacagctgacttgctgagaggaggcggggaggcgcggagcgcgcgtgtggtccttgcgccgctgac

SEQ ID NO: 1641 - DNA, 298 bp, Homo sapiens
cgcggaaacacccatccagaatgtcattctacatgagcatcacattttccttggtgccactaactacatttatgttttaaatgaggaagaccttcagaaggttgctgagtacaagactgggcctgtgctggaacacccagattgtttcccatgtcaggactgcagcagcaaagccaatttatcaggaggtgtttggaaagataacatcaacatggctctagttgtcgacacctactatgatgatcaactcattagctgtggcagcgtcaacagagggacctgccagcgacatgtcttt

SEQ ID NO: 1642 - DNA, 41 bp, Homo sapiens
gttcactgcatattctccccacagatagaagagcccagcca

SEQ ID NO: 1643 - DNA, 662 bp, Homo sapiens
cgccctgggagccaaagtcctttcatctgtaaaggaccggttcatcaacttctttgtaggcaataccataaattcttcttatttcccagatcatccattgcattcgatatcagtgagaaggctaaaggaaacgaaagatggttttatgtttttgacggaccagtcctacattgatgttttacctgagttcagagattcttaccccattaagtatgtccatgcctttgaaagcaacaattttatttacttcttgacggtccaaagggaaactctagatgctcagacttttcacacaagaataatcaggttctgttccataaactctggattgcattcctacatggaaatgcctctggagtgtattctcacagaaaagagaaaaaagagatccacaaagaaggaagtgtttaatatacttcaggctgcgtatgtcagcaagcctggggcccagcttgctagacaaataggagccagcctgaatgatgacattcttttcggggtgttcgcacaaagcaagccagattctgccgaaccaatggatcgatctgccatgtgtgcattccctatcaaatatgtcaacgacttcttcaacaagatcgtcaacaaaaacaatgtgagatgtctccagcatttttacggacccaatcatgagcactgcttta

SEQ ID NO: 1644 - DNA, 137 bp, Homo sapiens
agcgcgccgtgatgaatatcgaacagagtttaccacagctttgcagcgcgttgacttattcatgggtcaattcagcgaagtcctcttaacatctatatccaccttcattaaaggagacctcaccatagctaatcttg

SEQ ID NO: 1645 - DNA, 48 bp, Homo sapiens
ttgtggtttctcgatcaggaccatcaacccctcatgtgaattttctcc

SEQ ID NO: 1646 - DNA, 32 bp, Homo sapiens
tcacgaagatcccattgaatggcttgggctgc

SEQ ID NO: 1647 - DNA, 72 bp, Homo sapiens
tggctggtgccacgacaaatgtgtgcgatcggaggaatgcctgagcgggacatggactcaacagatctgtct

SEQ ID NO: 1648 - DNA, 111 bp, Homo sapiens
atatgtggctgggactttggatttcggaggaataataaatttgatttaaagaaaactagagttctccttggaaatgagagctgcaccttgactttaagtgagagcacgatg

SEQ ID NO: 1649 - DNA, 25 bp, Homo sapiens
attgaaatgcacagttggtcctgcc

SEQ ID NO: 1650 - DNA, 50 bp, Homo sapiens
aattatttcaaatggccacgggacaacacaatacagtacattctcctatg

SEQ ID NO: 1651 - DNA, 101 bp, Homo sapiens
taataacaagtatttcgccgaaatacggtcctatggctggtggcactttacttactttaactggaaattacctaaacagtgggaattctagacacatttca

SEQ ID NO: 1652 - DNA, 123 bp, Homo sapiens
aacagtattcttgaatgttataccccagcccaaaccatttcaactgagtttgctgttaaattgaaaattgacttagccaaccgagagacaagcatcttcagttaccgtgaagatcccattgtc

SEQ ID NO: 1653 - DNA, 38 bp, Homo sapiens
tacttggtggaaagaacctctcaacattgtcagttttc

SEQ ID NO: 1654 - DNA, 77 bp, Homo sapiens
tggtgggagcacaataacaggtgttgggaaaaacctgaattcagttagtgtcccgagaatggtcataaatgtgcatg

SEQ ID NO: 1655 - DNA, 60 bp, Homo sapiens
gcatgtcaacatcgctctaattcagagataatctgttgtaccactccttccctgcaacag

SEQ ID NO: 1656 - DNA, 101 bp, Homo sapiens
catgttagatgggatcctttccaaatactttgatctcatttatgtacataatcctgtgtttaagccttttgaaaagccagtgatgatctcaatgggcaatg

SEQ ID NO: 1657 - DNA, 125 bp, Homo sapiens
tgaagcagttaaaggtgaagtgttaaaagttggaaataagagctgtgagaatatacacttacattctgaagccgttttatgcacggtccccaatgacctgctgaaattgaacagcgagctaaata

SEQ ID NO: 1658 - DNA, 30 bp, Homo sapiens
attcctctcatgatgtaaataaggaagcca

SEQ ID NO: 1659 - DNA, 53 bp, Homo sapiens
gtaattatgttattctcaggcttaaaataaatcattaaagctcatttatgtgt

SEQ ID NO: 1660 - DNA, 96 bp, Homo sapiens
aagcaatttcttcaaccgtccttggaaaagtaatagttcaaccagatcagaatttcacaggattgattgctggtgttgtctcaatatcaacagcac

SEQ ID NO: 1661 - DNA, 137 bp, Homo sapiens
tgggcagtgaattagttcgctacgatgcaagagtacacactcctcatttggataggcttgtaagtgcccgaagtgtaagcccaactacagaaatggtttcaaatgaatctgtagactaccgagctacttttccagaa

SEQ ID NO: 1662 - DNA, 187 bp, Homo sapiens
tcagaacggttcatgccgacaagtgcagtatcctctgacagacatgtcccccatcctaactagtggggactctgatatatccagtccattactgcaaaatactgtccacattgacctcagtgctctaaatccagagctggtccaggcagtgcagcatgtagtgattgggcccagtagcctgattgtg

SEQ ID NO: 1663 - DNA, 31 bp, Homo sapiens
ggcattttggttgtgtatatcatgggacttt

SEQ ID NO: 1664 - DNA, 112 bp, Homo sapiens
atttctgaccgagggaatcatcatgaaagattttagtcatcccaatgtcctctcgctcctgggaatctgcctgcgaagtgaagggtctccgctggtggtcctaccatacatg

SEQ ID NO: 1665 - DNA, 78 bp, Homo sapiens
gtaaaagatcttattggctttggtcttcaagtagccaaaggcatgaaatatcttgcaagcaaaaagtttgtccacaga

SEQ ID NO: 1666 - DNA, 136 bp, Homo sapiens
acagtcaaggttgctgattttggtcttgccagagacatgtatgataaagaatactatagtgtacacaacaaaacaggtgcaaagctgccagtgaagtggatggctttggaaagtctgcaaactcaaaagtttacca

SEQ ID NO: 1667 - DNA, 86 bp, Homo sapiens
ccttatcctgacgtaaacacctttgatataactgtttacttgttgcaagggagaagactcctacaacccgaatactgcccagaccc

SEQ ID NO: 1668 - DNA, 105 bp, Homo sapiens
tgctggcaccctaaagccgaaatgcgcccatccttttctgaactggtgtcccggatatcagcgatcttctctactttcattggggagcactatgtccatgtgaac

SEQ ID NO: 1669 - DNA, 52 bp, Homo sapiens
gtgtcgctccgtatccttctctgttgtcatcagaagataacgctgatgatga

SEQ ID NO: 1670 - DNA, 28 bp, Homo sapiens
gtggacacacgaccagcctccttctggg

SEQ ID NO: 1671 - DNA, 145 bp, Homo sapiens
gcaacagtccacactttgtccaatggttttttcactgcctgacctttaaaaggccatcgatattctttgctcttgccaaaattgcactattataggacttgtattgttatttaaattactggattctaaggaatttcttatctga

SEQ ID NO: 1672 - DNA, 65 bp, Homo sapiens
accagaggcttggtcccacaggccacggaccaatggcctgcagccgtgacaacactcctgtcata

SEQ ID NO: 1673 - DNA, 26 bp, Homo sapiens
ccaaaacttgaattctgggttgaatt

SEQ ID NO: 1674 - DNA, 59 bp, Homo sapiens
gtaccacttgatttcatatgggaaattgaagcaggaaatattgagggcttcttgatcac

SEQ ID NO: 1675 - DNA, 433 bp, Homo sapiens
acacttttgtgtgttgtatggtcaataacatttttcattactgatggtgtcattcacccattaggtaaacattcccttttaaatgtttgtttgttttttgagacaggatctcactctgttgccagggctgtagtgcagtggtgtgatcatagctcactgcaacctccacctcccaggctcaagcctcccgaatagctgggactacaggcgcacaccaccatccccggctaatttttgtattttttgtagagacggggttttgccatgttgccaaggctggtttcaaactcctggactcaagaaatccacccacctcagcctcccaaagtgctaggattacaggcatgagccactgcgcccagcccttataaatttttgtatagacattcctttggttggaagaatatttataggcaatacagtcaaagtttca

SEQ ID NO: 1676 - DNA, 40 bp, Homo sapiens
agttgtcatataaaaacccactgtttgagaatgatgctac

SEQ ID NO: 1677 - DNA, 773 bp, Homo sapiens
aagattagcctctgtctcggtggcaggttcccacctcgcaagcaattggaaacaaaacttttggggagttttattttgcattagggtgtgttttatgttaagcaaaacatactttagaaacaaatgaaaaaggcaattgaaaatcccagctatttcacctagatggaatagccaccctgagcagaactttgtgatgcttcattctgtggaattttgtgcttgctactgtatagtgcatgtggtgtaggttactctaactggttttgtcgacgtaaacatttaaagtgttatattttttataaaaatgtttatttttaatgatatgagaaaaattttgttaggccacaaaaacactgcactgtgaacattttagaaaaggtatgtcagactgggattaatgacagcatgattttcaatgactgtaaattgcgataaggaaatgtactgattgccaatacaccccaccctcattacatcatcaggacttgaagccaagggttaacccagcaagctacaaagagggtgtgtcacactgaaactcaatagttgagtttggctgttgttgcaggaaaatgattataactaaaagctctctgatagtgcagagacttaccagaagacacaaggaattgtactgaagagctattacaatccaaatattgccgtttcataaatgtaataagtaatactaattcacagagtattgtaaatggtggatgacaaaagaaaatctgctctgtggaaagaaagaactgtctctaccagggtcaaga

SEQ ID NO: 1678 - DNA, 25 bp, Homo sapiens
tcatgcaattaaagtaaagtgatgc

SEQ ID NO: 1679 - DNA, 25 bp, Homo sapiens
gagctgagagttaagctgaacaaaa

SEQ ID NO: 1680 - DNA, 172 bp, Homo sapiens
tcctgagcatgcctagggaatgacaggcatctccacaggcaggctgcatccaccttggctggggtgtcgtcattggctgcctattagaaaaacgacaggacaatgcataccaccgcctcccgactgtaaacataggggatatgtgttcacttagcatggacttctgggaggg

SEQ ID NO: 1681 - DNA, 26 bp, Homo sapiens
tcctcgggaagaagtttcagactaca

SEQ ID NO: 1682 - DNA, 38 bp, Homo sapiens
agatcatcaaatcaaattccacagggattggtgaccaa

SEQ ID NO: 1683 - DNA, 81 bp, Homo sapiens
tggcacagaaacgcaggggaaacgggctcctcatttaaagagctggaaggggaaggtctttccggaattaaaaccatcaca

SEQ ID NO: 1684 - DNA, 40 bp, Homo sapiens
tccagacatcatctggtctccctgaacctgaaatcacacc

SEQ ID NO: 1685 - DNA, 38 bp, Homo sapiens
tggatgattttgagcgtcgcagagaacttagaaggcaa

SEQ ID NO: 1686 - DNA, 28 bp, Homo sapiens
aaggatctagggtgaaaaatacttgtat

SEQ ID NO: 1687 - DNA, 56 bp, Homo sapiens
cttttgagaggccaaatgtggtcatatcgcacaccaaactgttcgcaaaagtagtt

SEQ ID NO: 1688 - DNA, 172 bp, Homo sapiens
tgagaggaatcaattgataactgcatattgataattgcatttaatcaatacctttcacattggaatgttttaaatgacaaaagtaatgtgtgaatgaaggtttaaaaagcttatataataagaaatgacaaaaaaatgtcaagtattgaatattggaaccacttaggacatg

SEQ ID NO: 1689 - DNA, 40 bp, Homo sapiens
ggatccggatcgcatggaagacgcagcctggccgcgctct

SEQ ID NO: 1690 - DNA, 66 bp, Homo sapiens
ggaatgtctacattcaccttttctaggagtcagttctccaaatcactctacctttcactttgtaag

SEQ ID NO: 1691 - DNA, 134 bp, Homo sapiens
attgagtatctcagttaccagcctgaaatctccatcgaccaacactgccttctctcaaatgacttcttatatgaaagtggacagacagtggaatgcagaaattttagagctgatcttggggaccggtcaactgt

SEQ ID NO: 1692 - DNA, 37 bp, Homo sapiens
gccgccgagcccgacaggaacggctgcggcagaagca

SEQ ID NO: 1693 - DNA, 141 bp, Homo sapiens
atgatgaggccgcattcctggagcgcctggctcggcgtgaggaaagacgccaaaaacgccttcaggaggctctggagcggcagaaggagttcgacccaacaataacagatgcaagtctgtcgctcccaagcagaagaatgc

SEQ ID NO: 1694 - DNA, 32 bp, Homo sapiens
ctaccagaagaatgattggagggatgctgaag

SEQ ID NO: 1695 - DNA, 36 bp, Homo sapiens
gaggagaagccaaagcgagggagcattggagaaaat

SEQ ID NO: 1696 - DNA, 62 bp, Homo sapiens
ggcagatcagttcagaagagcctaaacaagaggaggagagggaacaaggttcagatgagatt

SEQ ID NO: 1697 - DNA, 63 bp, Homo sapiens
agagaaagaattaaagccgagcaagacaaaaagatagcagatgaacgagcaagaattgaagca

SEQ ID NO: 1698 - DNA, 31 bp, Homo sapiens
agagagggaaaggatgagggaggaagagaaa

SEQ ID NO: 1699 - DNA, 30 bp, Homo sapiens
aggagaggcagaggataaaagaggaagaga

SEQ ID NO: 1700 - DNA, 57 bp, Homo sapiens
agagcagaaacgtaacaagcagctagaagagaaaaaacatgccatgcaagagacaaa

SEQ ID NO: 1701 - DNA, 69 bp, Homo sapiens
gagaagagaagggaactaaagtgcaagctaaaagagaaaagctccaagaagacaagcctaccttcaaaa

SEQ ID NO: 1702 - DNA, 85 bp, Homo sapiens
gttaagagcttcatggatcgaaagaagggatttacagaagttaagtcgcagaatggagaattcatgacccacaaacttaaacata

SEQ ID NO: 1703 - DNA, 40 bp, Homo sapiens
gagggagggccagcgtggacaccaaggaggctgagggcgc

SEQ ID NO: 1704 - DNA, 191 bp, Homo sapiens
aaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagagg

SEQ ID NO: 1705 - DNA, 288 bp, Homo sapiens
ctagcccactgagaacgttgcccgggaaaattccctagtgccgtgcggctgttcttttgagcatgggctctcaaaaatatttttttaagaataataaacttaccatgtgctaggtactgttttataacttgtagatgtattaatttgtccactgcttctaagaactcgctgacctaggtactaatccccattttacagatgagaaaactgaggcacagagaggttttgtttttgtttttgtttttgtttgtaactttcccaaggtctcccttgagtctgcctgacatg

SEQ ID NO: 1706 - DNA, 27 bp, Homo sapiens
tagaagagcgagcagaatttttgaata

SEQ ID NO: 1707 - DNA, 74 bp, Homo sapiens
aagcgcaaaacctacaaagccggcagcctcggatcttcctgttcctgctgaaggtgtacgcaacatcaagagta

SEQ ID NO: 1708 - DNA, 195 bp, Homo sapiens
gcatgtcgattttgatttaggaatcacactagtaaataataaaagcagtgaagaaggtgcaatttgtactttgttttgcaatgaccacaaaagcaagctcagagagaatgtgtttgtgaggttgcatgaggtactaagcccgggccatcttactccaaataaagtgcctgggctgaaatgtccacccttggagtt

SEQ ID NO: 1709 - DNA, 72 bp, Homo sapiens
ttgaaggtaggggtttctagccgcatcaatgaatggctaactaaaaccccagatggaaacaagtcacctgct

SEQ ID NO: 1710 - DNA, 25 bp, Homo sapiens
tctgagtttctttgatctcccagct

SEQ ID NO: 1711 - DNA, 111 bp, Homo sapiens
cagatttacaacagttctaagaagctgcatctcagttactcagagggtaaaatggaaccaaataatcacctctacaccctaactgagaggaggaatcagctagaatactga

SEQ ID NO: 1712 - DNA, 903 bp, Homo sapiens
cctaggcctctgtgcatttaattgcatccattggctccatgccatttaattgcatttgttggctccatatataatctccaaagtcattaaattttgtcactttccaatttaaaaaggaagaaatggaaatgttcacaaatccttcttgggcacaactccttgaaccgtttaattaatctacaccccgagattctttgcataaaggctcacaggaggtatacactaatgtcaacccaatttacaattggaaaatctttatacattgaaaaaagcaacttttcctccccctctcaataggtacaagaatgcgggtttataaaaggacacagttgaggcaagagaccggacccaaaagttatgtgctctttagtgcctcaagttttccaagcatctctggtaacataaggagtagaaattattttcaaaaacaaaataatcactggttccagaccagtgattattaaccctttttgaattatgaacccctttaaaacctaatgaaatttaaggaccctctcccccaaaatatacatataaaaaaacaaggcagtctatggacctactgagtaactctcaagatagtaagtaaggagagaaagatctatgtttccctctttgataagtatgaaatatttggaggagatgctaatttttgcacgtttatgatatttgcaatctttcatttttgtagcagattatactcaaaaatttgatccagaacttggcccctattcttttatcagcactttaacttgtaaactgaaaagtttaccatcatctgtatgacatcctaatgaggttaaaaagataaaatgcagttatgattatgataggtataactgtatccaggtttccacagcaaaaacaaaacaaaacatacaccatgttctggggttattgaca

SEQ ID NO: 1713 - DNA, 95 bp, Homo sapiens
tgaccttctgttcctcactctttggtctctggttgattggaaacctgcttctcctgccttcatttctccctcttcttccggagtgggtctttctc

SEQ ID NO: 1714 - DNA, 55 bp, Homo sapiens
ttgagaccaggagacgtatccagcaagcggaacctctgggaaaagcaatctgtgg

SEQ ID NO: 1715 - DNA, 160 bp, Homo sapiens
gacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtac

SEQ ID NO: 1716 - DNA, 124 bp, Homo sapiens
gctgtgaaatagagacttttctactgatcatcataactctgtatctgagcagtgataccaaccacatctgaagtcaacagaagatccaagtttaaaattgcctgcggaatgtgtgcagtatcta

SEQ ID NO: 1717 - DNA, 267 bp, Homo sapiens
tttagtagtgatagtagcctgaaccacattttagataactcaattatgtatgtatgtgcatacacatatacaaacacactaatggtagaatgcttttttatgtgctagactattatatttagtagtatgtcattgtaactagccaatatcacagcttttgaaaaattaaaaaatcacactatattaatattttatatttgccaacagaaacatggcagataggtatcaatatgttttcaatgcctgatgacctataagaagaaagta

SEQ ID NO: 1718 - DNA, 905 bp, Homo sapiens
tcacaataggtcataaggtctcttccttttctaaaattgaaagacaagaaatttagtgccaatattgtacagacagaaattccatgtatgagtctcaacaaagactacctttggctaaatgtctagaagcagagaagtaaagtgagcaaaatccagtgttgaggagtcatgacagtactttgatctttatatactctgaagcatttcttcaaacttttctacttttatttgtcattgatacctgtagtaagttgacaatgtggtgaaatttcaaaattatatgtaacttctactagttttactttctcccccaagtcttttttaactcatgatttttacacacacaatccagaacttattatatagcctctaagtctttattcttcacagtagataatgaaagagtcctccagtgtcttggcaaaatgttctagtatagctggatacatacagtggagttctataaactcatacctcagtggacttaaccaaaattgtgttagtctcaattcctaccacactgagggagcctcccaaataactattttcttatctgcagtattcctccagaagagctaaccagggcagggctggcatgagaagtgacatctgcgttacaaagtctatcttcctcataagtctgtaaagagcaattgaatcttctagctttagcaaacctaagccaaaggaaggaaagccatgaagaatgcagaagtcaaaccctcatgacaaagtaggcacaagtctacaataagctaaatcagaatttacaaatacaagtgtcccaggtagcattgactcccgtcattggagtgaaatggatcaaagtttgaattaaggcctatggtaaggtaacattgctttgttgtacttttgaacaagagctcctcctgatcactattaca

SEQ ID NO: 1719 - DNA, 31 bp, Homo sapiens
atattgatagtgagaggtatgtctattataa

SEQ ID NO: 1720 - DNA, 232 bp, Homo sapiens
ctctggccaggaactctaaggtacacactttcatttagtaattaaattttagtcagattttgcccaacctaatgctctcagggaaagcctctggcaagtagctttctccttcagaggtctaatttagtagaaaggtcatccaaagaacatctgcactcctgaacacaccctgaagaaatcctgggaattgaccttgtaatcgatttgtctgtcaaggtcctaaagtactgga

SEQ ID NO: 1721 - DNA, 209 bp, Homo sapiens
tctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatga

SEQ ID NO: 1722 - DNA, 34 bp, Homo sapiens
gaaagctctcaagttgctgaagactgaattgtaa

SEQ ID NO: 1723 - DNA, 79 bp, Homo sapiens
agagagctaggcttagggacgcctcggactcagtttgaccctaactagccttgcatcttcaggcaaatcacactctttc

SEQ ID NO: 1724 - DNA, 69 bp, Homo sapiens
gtaagtgtgaccttcaattcggatgttgcccaagagttgaacacctctattgctgtagtgatgggacta

SEQ ID NO: 1725 - DNA, 58 bp, Homo sapiens
acaactgacaaacacctttctcctgatggccagtatgtccccaggattatgtttgttg

SEQ ID NO: 1726 - DNA, 69 bp, Homo sapiens
ttaaagaaagtgtttgctgaaaataaagaaatccagaaattggcagagcagtttgtcctcctcaatctg

SEQ ID NO: 1727 - DNA, 28 bp, Homo sapiens
aagaagctctatataaatccaagacaag

SEQ ID NO: 1728 - DNA, 53 bp, Homo sapiens
taggagtcagcttcttgttggcttccaactgctacttaattggaaaagatttc

SEQ ID NO: 1729 - DNA, 103 bp, Homo sapiens
tcagcattcttgctccttgtggccctctcctacactctggccagagataccacagtcaaacctggagccaaaaaggacacaaaggactctcgacccaaactgc

SEQ ID NO: 1730 - DNA, 63 bp, Homo sapiens
gccacgatgaattaggagaacaagatgtcaaattacactgatgctgagtcaagcttctcaaag

SEQ ID NO: 1731 - DNA, 305 bp, Homo sapiens
ggtgatcggatgttctttctaaggatcatattccacatttaaagagatggtgactgagaagaggtggcaagctgaaccatctcactttgagattgacgtatcacgttttatcctctgccatcatttccttgttaattgtttttctttgggtgattggaagaatctatggcttccttttctctgttcttaaagatatcaagactctgcccttttgtgactggaagtagattttaaatgtccctaatgtttatatgctcacttaaactcaatacatggaatttactggggcatttaacttgttcatg

SEQ ID NO: 1732 - DNA, 207 bp, Homo sapiens
cattggtttcactaggagcttctcaaagcacgctgccaaacatgctccagtctcattgtcaaggccttagaccaggcaatcattacggcagtggttcttcaacttcagcagcagcaaaacgatctggcgggggcttggtgaaacagactgctgggctcgaccaccagaatttctcattcagagggtctggcctgatcacttgcattt

SEQ ID NO: 1733 - DNA, 777 bp, Homo sapiens
ttcatggcctgtaatgtagaacatactatataaagttctcagtttggggatgactaggtttctggaaggaatagaatgctaaatcaatggatggcattgggctgagaaacactgctgctactaatcagccttgaatgtgtaatgtgaacatgcaaaagagaacatgcatacactcaaatttgtacaatgctataactggaagttgaaggacttgaatttttatattgtgctattgttatgttttctgtaattgtttatatctaaggaatttttgaggtaatataaaagaaaaagagaataatgaacaatgatgtcactggagggtttttacattaaattagatcatttttcttcttattcacaataataatcttaatctttaagaattaattataatttaatattataattcataatctttaagaattaataattataatttaatattataattaataatctttaagaattaataatataatttaatattataattaataatctttaagaattaataattacaattaataattaataataatcttaatctttaagaattaataataatccttaatcgcaataataatcgcaaggaggagaagtaagtccctcctccttctgtatgaacttttctcccacatgctgctgtatggtttagtgagagtgaagttctaaagaacatcaatatgattggtgggataatccaaagacattttttcagaatcaaatggcatgtcgaaggtttgtttcttgcatatgtatttactggtccacagc

SEQ ID NO: 1734 - DNA, 66 bp, Homo sapiens
caccctgggatatttggtatgctggcaatggtaattcaaattggcgtttaagaataatcttggccg

SEQ ID NO: 1735 - DNA, 472 bp, Homo sapiens
ggaccctgggtcagtataaatgctaatggctgacaaagttcacaaagagatgtattttgcttactcctctgttcaatcctctggttgcctgccagtgtttatgtgtgtatttggacagacattcatttattgtcattcagtcaataggtagagtatatgtgtctattttttggcaggcatatagatgcttgaggctaatgggaaaaaaccagcatgaactctgactttagtagtgctaagtaatagataattttaaaaaatgacaccgttaaatagaaaatggcatgcatactaacagttgcaatggagaggctgtgatgctacgagatataaacgtagagatgccatcatgtgaaactggaagtgggggtgggtcagggaaatttgttcttggaaagaaataatgaacctcaaggaagagtaggcattgtcctggtgtggtggggtgtaagcggtgatcccacaaagcact

SEQ ID NO: 1736 - DNA, 148 bp, Homo sapiens
aacagttgccgtttcattttaagtgagacttgctactctttttcatcgtctcttgaaagactgacagaaggaaaatatgacttatcagaaatctgttgtctgcatgcatggacctagtgttttcatcagctcccttcagcatcttggg

SEQ ID NO: 1737 - DNA, 143 bp, Homo sapiens
caagcacacaccctgtggccagtcacggctgcccgctttccacacctgacctcttcagttcatcagtggggttcaccagcatcacccccatttttcatggggagaaactcagaagtggagagaacgtctgaggctacatagcc

SEQ ID NO: 1738 - DNA, 47 bp, Homo sapiens
ctgatgaaagcacagcctaactgataaccaagatgggttttatcctc

SEQ ID NO: 1739 - DNA, 25 bp, Homo sapiens
gaaaatgaggtaatggtgtgtgtgt

SEQ ID NO: 1740 - DNA, 148 bp, Homo sapiens
gagatgtgttacaagaccttcagtcagctttggacagaatgaaaaaccctgtgactaaacactggagagaattaactggagttttaatactagtaaattctttggaggttttgagagtaactgcattctccacttctgaggaagtata

SEQ ID NO: 1741 - DNA, 137 bp, Homo sapiens
tagtcgcacgtctcatccaagaagctgctgttctgacttcagctgtcaagcttggaaaaggctggagggaactagctgaaaagttagtacgactcacaaagcaacaaatggaggcatatgaaattcctcatcgagga

SEQ ID NO: 1742 - DNA, 94 bp, Homo sapiens
cagaaaaagtttatgattggaaagttttagctgatgtcctgggttactcacatctgtccctggaagattttgatcaaattcaagcagacaaaga

SEQ ID NO: 1743 - DNA, 214 bp, Homo sapiens
tttcaaaggggacacaatagctctcctcggggaaggtaaggtaaaagctattggtcagtccaaagtgaaagaatggtatgtaggagtcctcagaggtaagattggacttgtacactgcaaaaatgtcaaggtgatttcaaaggagcaagtaatgtttatgtcagatagtgtctttacaaccagaaatcttcttgaacagattgtcctgccttta

SEQ ID NO: 1744 - DNA, 219 bp, Homo sapiens
ttttgtgttcaagtggagcctcccaatggtgaaccagttgcacagttctctatcactactcctgatccaaccccaaacctaaaaagactctcgaatctgccaggctatttgcagaagaaggaggaaatcaagtctgctcctttatcaccaaaaattcttgttaaatatcctacatttcaagataaaacattgaactttagcaactatggggtaaccctg

SEQ ID NO: 1745 - DNA, 261 bp, Homo sapiens
gcccgctcctgccttgatttgaatacaattagtcagagccctggatgggcccagacacaacttgcggaggtcaccatagcttgcaaagtaaaccatcaaggagggtcagtacaattacctgaatcagacatcactgttcatgtgccccaaggtcatgtggctgtgggagaattccaagaggtgtctctaagggctttccttgatccgccacacatgcttaaccatgatctttcgtgcactgtgagcccgttgttggaaatc

SEQ ID NO: 1746 - DNA, 71 bp, Homo sapiens
caaatccattctggaatcaactgtctgcttctaacccatttttggatgacataactcaactaagaaataac

SEQ ID NO: 1747 - DNA, 61 bp, Homo sapiens
aggacccagacttgcttcacaattggccggatgctttcacccttcgtggtaataatgcttc

SEQ ID NO: 1748 - DNA, 34 bp, Homo sapiens
aacattttcggtcaggaagaattgcacaaagtat

SEQ ID NO: 1749 - DNA, 31 bp, Homo sapiens
aggaggggtcacaggtgaacgagatgtggtc

SEQ ID NO: 1750 - DNA, 25 bp, Homo sapiens
gtagccttgtcagatgatatgcaaa

SEQ ID NO: 1751 - DNA, 122 bp, Homo sapiens
gaagaaattataggcgaggctgagatctaaaaggagagctccagaatggaggcttggaccaggggcagaccaggagcttatcaagatacaattgaataatcaaagggtggagcctggacaaa

SEQ ID NO: 1752 - DNA, 72 bp, Homo sapiens
ccgggtttggtagagtgacttctattcactaaaaccatgtgtctgaactgaagaagcttgggctcacttcca

SEQ ID NO: 1753 - DNA, 25 bp, Homo sapiens
ctgggctttgtatcactaattattt

SEQ ID NO: 1754 - DNA, 26 bp, Homo sapiens
gagaagtttgtcttgcaatgtattta

SEQ ID NO: 1755 - DNA, 84 bp, Homo sapiens
tgctgcagacctcggtgtggacacacgctgcatagagctctccttgaaaacagaggggtctcaagacattctgcctacctatta

SEQ ID NO: 1756 - DNA, 81 bp, Homo sapiens
gatgctatatgatacaactgtggccatgactgaggaaaggagctcacgcccagagactgggctgctctcccggaggccaaa

SEQ ID NO: 1757 - DNA, 259 bp, Homo sapiens
agcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactatt

SEQ ID NO: 1758 - DNA, 74 bp, Homo sapiens
gtgtggataagtatgggcagcctctcccaggctacaccaccaaggggaaggaggacgtgcactgctacagcatg

SEQ ID NO: 1759 - DNA, 82 bp, Homo sapiens
acagccagcgctacaaagttgactacgagtctcagagcacagatacccagaacttctcctccgagtccaagcgggagacaga

SEQ ID NO: 1760 - DNA, 30 bp, Homo sapiens
aaatgctagtgagtcggaggaagaccgcag

SEQ ID NO: 1761 - DNA, 27 bp, Homo sapiens
gtcaacgctagtgccgtcagccgcctg

SEQ ID NO: 1762 - DNA, 32 bp, Homo sapiens
tgtggctccggccttcgctgccagccgtcgcc

SEQ ID NO: 1763 - DNA, 27 bp, Homo sapiens
gtgcgacgcgcgtgcactggcccagtg

SEQ ID NO: 1764 - DNA, 27 bp, Homo sapiens
gcgcgacccacgctctgggccgctgcg

SEQ ID NO: 1765 - DNA, 27 bp, Homo sapiens
gcccagcctgccaagcagcgtgccccg

SEQ ID NO: 1766 - DNA, 65 bp, Homo sapiens
ctgggcgctgaggatcagccgcttcctgcctggattccacagcttcgcgccgtgtactgtcgccc

SEQ ID NO: 1767 - DNA, 1078 bp, Homo sapiens
cagtcttctgaaggtcatgcccacagaagtcatcagaccttaccaaagtaggttggagaattagattgccttttcatgcagtgagattcagttaagcaaaaatgaaatttgtctctatagctaattagcttatcaactcccctccaaacaaacaattaaaaaaaaaacatacagacactcaaattccacaagctaatgaacaaaagggactcttgtgagaagactaatgagtccctcatccagaagatgccaatgtactggcagattaacatacaacctatgttttgaacaaaaacaaccagcgatacgtaatcaaaatgtaattttcccctaataaaattatggatatgggcagtcatcaatggctgccaaaaccattaagtggaaagctgattaaaaaacaaaaatttctaatggatttatcaaactgtcccaaatcctgataaatattaacatcacagaggaagaccagacattatgggcctggaagtactataggagtgcacacatcacccgtgacatggtcttgccaaataattaaacctgaatttgatcaggtctctggatcttatttgcaattcaaaagaaattttaaaaaaatcctactaacaccaccacaaatatgcaatcagcaatatccagaaaggggaaattcacaggacaaaaacctggttttcttttttggtttcttcaaccaaaaaagaaagaaattgcaaaggaccaaaaaaatgttggggaatctatacattataagggacttaacaactaaagggcaacatatagactttagatcctaatttgagcaaaatctaaaatcaattattaggcaatcagaaaaatttgaacacagactagatatttgaggatattaaggtactatattattgaagattccatggttatgttttttaaagagttcatgccttttagagatacatactaaagtatttgtaaataaatgacatgatctagaatcagtaattttgtgtttggggtgtgggggtggtgaaagggaagtagaaccgaaacaagattagtcctgagttaacaatggctgcaagctggatacatggaattc

SEQ ID NO: 1768 - DNA, 37 bp, Homo sapiens
ctgggattttccattggaggcccacttgcttatgaca

SEQ ID NO: 1769 - DNA, 1156 bp, Homo sapiens
gctcttttggatttagcagaacatgcctcaagtgcattcaaagaatctcaacagcaaagtgaagatagagagtatgaagtgaaggaaagattgtatccgaagtcaaaaaggcggtatgatacttacaatatagctggttatcaaggagagatagaagttgggctttacacaatccaaattctccagctcattcctttttttgataataaaaatgagctatctaaaagatatatggtcaattttgtatcaggaagtagtgatattccaggggatccaaacaatgaatataaattagccctcaaaaactatattccttatttaactaaattgaaattttctttgaaaaagtcctttgatttttttgatgaatactttgtcctgctaaaacccaggaacaatattaagcaaaatgaagaggccaaaactcggagaaaggtggctggatattttaagaaatatgtagatatattttgtctcttagaagaatcacaaaacaacacaggtcttggatcaaagttcagtgagccacttcaagtagagagatgcaggagaaacctagtagctttaaaagcagacaagttttctgggctcttggaatatcttatcaaaagtcaagaggatgctataagcactatgaaatgtatagtgaacgaatatacttttctcttagaacaatgcactgtcaaaatccagtcaaaagaaaagctaaatttcatcttggccaacattattctctcctgtatccaacctacctccagattagtaaagccagttgaaaaactaaaagatcagcttcgagaagtcttgcaaccaataggactgacttatcagttttcagaaccgtattttctagcttccctcttattctggccagaaaatcaacaactagatcaacattctgaacaaatgaaagagtatgctcaagcactaaaaaattctttcaaggggcaatataaacatatgcatcgtacaaagcaaccaattgcatatttctttcttggaaaaggtaaaagactggaaagacttgttcacaaaggaaaaattgaccagtgctttaagaagacaccagatattaattccttgtggcagagtggagatgtgtggaaggaggaaaaagtccaagaacttttgcttcgtttacaaggtcgagctgaaa

SEQ ID NO: 1770 - DNA, 410 bp, Homo sapiens
cagaggtcatcgaatgtgggaactactgtggagtacgcatcattcactctttgattgcagagttctcactggaagaattgaagaaaagctatcacctgaataaaagtcaaattatgttggatatgctaactgagaatttgttcttcgatactggtatgggaaaaagtaaatttttgcaagatatgcacacactcctactcacaagacaccgcgatgaacatgaaggtgaaacaggaaattggttttccccatttattgaagcattacataaagatgaaggaaatgaagcagttgaagctgtattgcttgaaagtatccatcggttcaacccaaatgcattcatttgccaagcgttggcaagacatttctacattaaaaagaaggactttggcaatgctctaaactgggca

SEQ ID NO: 1771 - DNA, 254 bp, Homo sapiens
aaggatcccagacagtattgccgtaatacagcaactctctcccaaagaacagagagcttttgagcttaaattgaaagaaatcaaagaacagcataaaaactttgaggatttttattcctttatgatcatgaaaaccaattttaataaagaatacatagaaaatgtggtccggaatatcctgaaagggcagaatattttcaccaaggaagcaaagctcttttcttttctggctcttcttaattcatatgtgcctg

SEQ ID NO: 1772 - DNA, 166 bp, Homo sapiens
ccttggctatgcacattctctgggaactaaggaagaaattcagatgtgctgtgctgaaaaacaagacagtggatttttctgaaattggagaacaggtaaccagtttaatcacctatggggcaatgaaccgtcaggaatacgtacctgtactactccttgttgatga

SEQ ID NO: 1773 - DNA, 48 bp, Homo sapiens
aaaactgtgcagattcttctaaaccaacaagtaccaaaattattcatc

SEQ ID NO: 1774 - DNA, 73 bp, Homo sapiens
aggaagacttctatcgaggtggcaaagtgtcatggtggaacttctacttctcttctgaaagttattcttcacc

SEQ ID NO: 1775 - DNA, 194 bp, Homo sapiens
gcacccacacatatttcagggatggaaagatctacttgaagcaagattaataaaacaccaagatgaaatttcaagccaatgtatttctgctttaagccttgaagagatcaatggcactattcttaaactaaaatctgtgactcaatcttcaaaaaggcttttgccatctattggtttatcgactgtccttctga

SEQ ID NO: 1776 - DNA, 339 bp, Homo sapiens
agccgagtagcaaaccttcactttccaagtgtatatgtagaacagaaaaccacaccaaatgagacgatttctactctaaatctttaccatcaacccagctggattttctgcaatggcaggttagaccttgacagtgaaaaatataaaccctttgatccaagttcctggcaaagagaaagagcttctgatgtcaggaaactgatttcatttcttacacatgaagacataatgccaagagggaagtttttggtggtatttctattactgtcctctgtggatgacccaagagatcccctcattgagactttctgtgctttctaccaggatctcaaaggaatg

SEQ ID NO: 1777 - DNA, 160 bp, Homo sapiens
ttctctgaatgccaatatgattatttccagattaaaatgcaaaattacaacaacaaaatatgggaacaaagtaaaaaattctcactatttgtgcgagatgggaccagctctaaggacattacgaaaaataaagttgatttcagagcatttaaagcagatt

SEQ ID NO: 1778 - DNA, 309 bp, Homo sapiens
ggcaatctcattgatccgatacatgaattcaaagccttcacaaatacagcaacagccacagaagaggatgtcaagatgaaatttagcaatgaggttttccgatttgcttcagcttgtatgaattcacgtaccaatggcactattcattttggagtcaaagacaaaccccatgggaaaattgttggcatcaaagtcaccaatgataccaaggaagccctcattaaccatttcaatctgatgataaacaagtattttgaagaccatcaagtccaacaagcaaagaagtgcattcgagagccaagatttgtg

SEQ ID NO: 1779 - DNA, 385 bp, Homo sapiens
ttgatatgggcatcacacatggaccagctattcaaatagaagaactattcaaagaattgcggaaaacagccattgaagattcgattcagacatctaagatgggaaagcccagtaaaaatgctcctaaagaccaaactgtgtctcaaaaggaacgtagagaaacttcaaagcaaaaacaaaagggtaaagagaacccagatatggctaatccgtctgcaatgagtacaactgctaaaggttctaagtcactaaaagttgagctcatagaagataaaatagattatacaaaggaaaggcaaccatccatagacctgacatgtgtatcatatccatttgatgaattcagtaatccatatcgttacaagttggattttagtctacagcc

SEQ ID NO: 1780 - DNA, 69 bp, Homo sapiens
gaataggtggccttttgtgatctcctacatcaccctggaagtgagacttcttcggtttcttctagagtc

SEQ ID NO: 1781 - DNA, 84 bp, Homo sapiens
tacttttctctagcatcgtaggaggaagaaaacaaacacatcagatattttcagcactaaaagagatggttttccccacatata

SEQ ID NO: 1782 - DNA, 58 bp, Homo sapiens
gaaattatttttccatctgaggaaaaaaatactaggaaaataaatcaaggtgatgctg

SEQ ID NO: 1783 - DNA, 29 bp, Homo sapiens
ggaagcagagcatgtcctagttcaatgtt

SEQ ID NO: 1784 - DNA, 331 bp, Homo sapiens
atgtcacctgtggaacataaaaaggacatcagcaaacaggatcagttaactattgcatttatatgtaccgtaggctttgtattcaaaaattatctatagctaagtacacaataagcaaaaacaaaaagaaaagaaaatttttgtagtagcgttttttaaatgtatactatagtaccagtaggggcttataataaaggactgtaatcttatttaggaagttgacttatagtacatgataaatgatagacaattgaggtaagttttttgaaattatgtgacattttacattaaattttttttacattttttgggcagcaatttaaatgttatg

SEQ ID NO: 1785 - DNA, 36 bp, Homo sapiens
aaaggaaggcaagaaacaggagaagatgctggatta

SEQ ID NO: 1786 - DNA, 25 bp, Homo sapiens
atggattcgtctactgatgcaactg

SEQ ID NO: 1787 - DNA, 27 bp, Homo sapiens
aagatggtagagaggagtgtttgggtg

SEQ ID NO: 1788 - DNA, 144 bp, Homo sapiens
ccagttccaggcctggggagaatgtgacctgaacacagccctgaagaccagaactggaagtctgaagcgagccctgcacaatgccgaatgccagaagactgtcaccatctccaagccctgtggcaaactgaccaagcccaaacc

SEQ ID NO: 1789 - DNA, 108 bp, Homo sapiens
gtgtgtgcccaccagtggagactgtgggctgggcacacgggagggcactcggactggagctgagtgcaagcaaaccatgaagacccagagatgtaagatcccctgcaa

SEQ ID NO: 1790 - DNA, 82 bp, Homo sapiens
tgcaggctcaacagtaccagcagcagcgtcgaaaatttgcagctgccttcttggcattcattttcatactggcagctgtgga

SEQ ID NO: 1791 - DNA, 137 bp, Homo sapiens
agtgagtcatccgtccagaaggcggggagagcagcagcggcccaagcaggagctgcagcgagccgggtacctggactcagcggtagcaacctcgccccttgcaacaaaggcagactgagcgccagagaggacgtttc

SEQ ID NO: 1792 - DNA, 37 bp, Homo sapiens
ttgagtcaaaggcaggatcaggttccccgccttccag

SEQ ID NO: 1793 - DNA, 32 bp, Homo sapiens
ccttctaggatctccgcctggttcggcccgcc

SEQ ID NO: 1794 - DNA, 55 bp, Homo sapiens
catcagcattctaccagctgtgaaagtgtttgagcacacgggatatcccttccag

SEQ ID NO: 1795 - DNA, 205 bp, Homo sapiens
ctcagcctccaatccgtaagagacacccagccccagcaattggattgggcagcccgtcttgacacaccactgtgctgagtgcttgaggacgtgtttcaacagatggttggggttagtgtgtgtcatcacattcgagtggggattaagagaaggaaggctgccttgctggagctgtgtggtcttctccaagtgagagtcgcaggca

SEQ ID NO: 1796 - DNA, 114 bp, Homo sapiens
tgactctcccccttcggaggaggaaggaagtcccgctgccaccttatctctgctcctctgcctcctccctgttcccagagctttttctctagagaagattttgaaggcggcttt

SEQ ID NO: 1797 - DNA, 145 bp, Homo sapiens
tcttcacttctcttgaacaaggaactcactcagagactaacacaaaggaagtaatttcttacctggtcattatttagtctacaataagttcatccttcttcagtgtgaccagtaaattcttcccatactcttgaagagagcataa

SEQ ID NO: 1798 - DNA, 59 bp, Homo sapiens
acggccacccaccatcatctaaagaagataaacttggcaaatgacatgcaggttcttca

SEQ ID NO: 1799 - DNA, 66 bp, Homo sapiens
tctgcagatgttctgaatacctctgagaatagagattgattattcaaccaggatacctaattcaag

SEQ ID NO: 1800 - DNA, 27 bp, Homo sapiens
ttgtcagttttgcaacattggaccaaa

SEQ ID NO: 1801 - DNA, 110 bp, Homo sapiens
gggaagcctctgttcgactgtcagatccccgaggttcagaggacggatacagcaggaacgaaaaaacatccgacccaacattattcttgtgcttaccgatgatcaagatg

SEQ ID NO: 1802 - DNA, 86 bp, Homo sapiens
gctacatcccccctgggtggcgagaatggcttggattaatcaagaattctcgcttctataattacactgtttgtcgcaatggcatc

SEQ ID NO: 1803 - DNA, 159 bp, Homo sapiens
tacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcc

SEQ ID NO: 1804 - DNA, 41 bp, Homo sapiens
aacagacagggtaaggaccaatctggactgtgttatctttt

SEQ ID NO: 1805 - DNA, 28 bp, Homo sapiens
aactcctagttataactatgcaccaaat

SEQ ID NO: 1806 - DNA, 84 bp, Homo sapiens
aggaccaatgctgcccatccacatggaatttacaaacattctacagcgcaaaaggctccagactttgatgtcagtggatgattc

SEQ ID NO: 1807 - DNA, 114 bp, Homo sapiens
ctgtataacatgctcgtggagacgggggagctggagaatacttacatcatttacaccgccgaccatggttaccatattgggcagtttggactggtcaaggggaaatccatgcca

SEQ ID NO: 1808 - DNA, 91 bp, Homo sapiens
gtcccacagatcgttctcaacattgacttggcccccacgatcctggatattgctgggctcgacacacctcctgatgtggacggcaagtctg

SEQ ID NO: 1809 - DNA, 36 bp, Homo sapiens
aagaaggccaaaatttggcgtgatacattcctagtg

SEQ ID NO: 1810 - DNA, 42 bp, Homo sapiens
tttctacgtaagaaggaagaatccagcaagaatatccaacag

SEQ ID NO: 1811 - DNA, 44 bp, Homo sapiens
gcaatgcattgaggatacatctggcaagcttcgaattcacaagt

SEQ ID NO: 1812 - DNA, 131 bp, Homo sapiens
gtccggcagagcacgcggaacctctacgctcgcggcttccatgacaaagacaaagagtgcagttgtagggagtctggttaccgtgccagcagaagccaaagaaagagtcaacggcaattcttgagaaacca

SEQ ID NO: 1813 - DNA, 212 bp, Homo sapiens
tccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggccca

SEQ ID NO: 1814 - DNA, 77 bp, Homo sapiens
atgactctatccattgtgagagagaactgtaccaatcggccagagcgtggaaggaccataaggcatacattgacaaa

SEQ ID NO: 1815 - DNA, 93 bp, Homo sapiens
attgaagctctgcaagataaaattaagaatttaagagaagtgagaggacatctgaagagaaggaagcctgaggaatgtagctgcagtaaacaa

SEQ ID NO: 1816 - DNA, 156 bp, Homo sapiens
gctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagcc

SEQ ID NO: 1817 - DNA, 555 bp, Homo sapiens
tctacaagttaaccagagggctatgtggtataaaagatgtttgtggtcacagcctagctcaggctagagtgttgcagagaccatcccaaatcctccaggctgggctcaaggcttctctaaacccttctttgttgcaaaatcccatcttttcatgcttcattggtgacatgtggccatctgccacatagaacaagtgagagtactagttccatatctttattaaataaccatttttcttttgtacaaagaataaatagaaattctgatatttttcttctcatacttccgtcactcacccctctttggaaaccactgcataacagagctaaggggaggataaactaatgtgcctgaaattttactttagtcttcagcctataagagatcactatcttttttcccattttcacctagtttcacagcaaatttacctacggggggaaaggtattattattcttaacatgaaaccacaatatttataagaaagaaattgtgaactttaaagtgtaaagataagggaacactggaatggcaagcctgcctaaggtttttca

SEQ ID NO: 1818 - DNA, 92 bp, Homo sapiens
gagttctaacaataacacctactggtgtttgcgtacagttaatgagacgcataattttcttttctgtgagtttgctactggctttttggagt

SEQ ID NO: 1819 - DNA, 102 bp, Homo sapiens
cacacggtagaacgaggcattttgaatcagctacacgtacaactaatggagctcagaagctgtcaaggatataagcagtgcaacccaagacctaagaatctt

SEQ ID NO: 1820 - DNA, 29 bp, Homo sapiens
gaaataaagatggaggaagctatgaccta

SEQ ID NO: 1821 - DNA, 70 bp, Homo sapiens
aatgttgctgttcctggtaccctgttcggcccctctaacctccagagctatggtctcagatgcttccttt

SEQ ID NO: 1822 - DNA, 28 bp, Homo sapiens
gagaaggtcattagtccaccaagaagcc

SEQ ID NO: 1823 - DNA, 31 bp, Homo sapiens
aggacagttatgggatggatgggaaggttaa

SEQ ID NO: 1824 - DNA, 537 bp, Homo sapiens
ttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagta

SEQ ID NO: 1825 - DNA, 27 bp, Homo sapiens
actaataaaggtaatcacagccaccaa

SEQ ID NO: 1826 - DNA, 571 bp, Homo sapiens
ccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaa

SEQ ID NO: 1827 - DNA, 669 bp, Homo sapiens
gtgcctagcctcaaagcgttcatcatacatcatacctttaagattgctatattttgggttattttcttgacaggagaaaaagatctaaagatcttttattttcatcttttttggttttcttggcatgactaagaagcttaaatgttgataaaatatgactagttttgaatttacaccaagaacttctcaataaaagaaaatcatgaatgctccacaatttcaacataccacaagagaagttaatttcttaacattgtgttctatgattatttgtaagaccttcaccaagttctgatatcttttaaagacatagttcaaaattgcttttgaaaatctgtattcttgaaaatatccttgttgtgtattaggtttttaaataccagctaaaggattacctcactgagtcatcagtaccctcctattcagctccccaagatgatgtgtttttgcttaccctaagagaggttttcttcttatttttagataattcaagtgcttagataaattatgttttctttaagtgtttatggtaaactcttttaaagaaaatttaatatgttatagctgaatctttttggtaactttaaatctttatcatagactctgtacatatgttcaaattagctgcttgcctgatgtgtgtatcatcggtgggatgacagaacaaac

SEQ ID NO: 1828 - DNA, 72 bp, Homo sapiens
ttaggaagcatactctgttttttaatcatgtataatattccatgatacttttatagaacaattctggcttca

SEQ ID NO: 1829 - DNA, 124 bp, Homo sapiens
atcagcccaggacggtcttcccggtgcagtttctgatgcggggagggcagtgctgccttccggtcaccaggaccagtgctcagcccgcctgcttgacccccttacttagctggggtccaatcca

SEQ ID NO: 1830 - DNA, 44 bp, Homo sapiens
ggctgtgctgcttgccctgttgatggcaggcttggccctgcagc

SEQ ID NO: 1831 - DNA, 55 bp, Homo sapiens
ccctgctgtgctactcctgcaaagcccaggtgagcaacgaggactgcctgcaggt

SEQ ID NO: 1832 - DNA, 320 bp, Homo sapiens
ctttctggccatctgtccgcatctgtgtgctgttttccttccacctgtccccgacccgtcccgcacctgcacccccaacaatcacccagcatctgtccctccagccatcctcctccatctgccactcctccactcatctgtccctccccatcctccatcttccactcctccacccatctgtccctccccatccctgagctcacttactcactcaccccatttctgacgctcagcgggtggtccatctgcctcggacatctggatagggctgagaccagggccgagaccaggccctcgcactgcttgcaatcctgaggcca

SEQ ID NO: 1833 - DNA, 96 bp, Homo sapiens
agcttgaactgcgtggatgactcacaggactactacgtgggcaagaagaacatcacgtgctgtgacaccgacttgtgcaacgccagcggggcccat

SEQ ID NO: 1834 - DNA, 473 bp, Homo sapiens
gaggcacatcctaacgcaagtctgaccatgtatgtctgcgcccctgtcccccaccctgaccctcccatggccctctccaggactcccacccggcagatcggctctattgacacagatccgcctgcagatggcccctccaaccctctctgctgctgtttccatggcccagcattctccacccttaaccctgtgctcaggcacctcttcccccaggaagccttccctgcccaccccatctatgacttgagccaggtctggtccgtggtgtcccccgcacccagcaggggacaggcactcaggagggcccggtaaaggctgagatgaagtggactgagtagaactggaggacaggagtcgacgtgagttcctgggagtctccagagatggggcctggaggcctggaggaaggggccaggcctcacattcgtggggctccctgaatggcagcctcagcacagcgtaggcccttaata

SEQ ID NO: 1835 - DNA, 606 bp, Homo sapiens
tcctgtgctgaccaaccaaataatatgtatagacacacacacatatgcacacacacacacacacacccacagagagagagctgcaagagcatggaattcatgtgtttaaagataatcctttccatgtgaagtttaaaattactatatatttgctgatggctagattgagagaataaaagacagtaacctttctcttcaaagataaaatgaaaagcacattgcatcttttcttcctaaaaaaatgcaaagatttacattgctgccaaatcatttcaactgaaaagaacagtattgctttgtaatagagtctgtaataggatttcccataggaagagatctgccagacgcgaactcaggtgccttaaaaagtattccaagtttactccattacatgtcggttgtctggttgccattgttgaactaaagcctttttttgattacctgtagtgctttaaagtatatttttaaaagggaggaaaaaaataacaagaacaaaacacaggagaatgtattaaaagtatttttgttttgttttgtttttgccaattaacagtatgtgccttgggggaggagggaaagattagctttgaacattcctggcgcatg

SEQ ID NO: 1836 - DNA, 144 bp, Homo sapiens
tttcttgccctcactgcaacagagcatttgcagacaggtcaaatctgagggctcatctgcagacccattctgatgtaaagaaataccagtgcaaaaactgctccaaaaccttctccagaatgtctctcctgcacaaacatgagg

SEQ ID NO: 1837 - DNA, 158 bp, Homo sapiens
tgcgatgcccagtctagaaaatctttcagctgtaaatactgtgacaaggaatatgtgagcctgggcgccctgaagatgcatattcggacccacacattaccttgtgtttgcaagatctgcggcaaggcgttttccagaccctggttgcttcaaggaca

SEQ ID NO: 1838 - DNA, 282 bp, Homo sapiens
tgagagttactccatgcctgtcataccacaaccagagatcctcagctcaggagcatacagccccatcactgtgtggactaccgctgctccattccacgcccagctacccaatggcctctctcctctttccggatactcctcatctttggggcgagtgagtccccctcctccatctgacacctcctccaaggaccacagtggctcagaaagccccattagtgatgaagaggaaagactacagtccaagctttcagacccccatgccattgaagctgaaaagtt

SEQ ID NO: 1839 - DNA, 59 bp, Homo sapiens
caagaagcatttcaacgcctccaaaaagccaaactacagcgaactggacacacatacag

SEQ ID NO: 1840 - DNA, 135 bp, Homo sapiens
tcccagccaaaacgggctcagttcgtaaaggagccgggtgacttcagaggcgccggcccgtccgtctgccgcacctgagcacggcccctgcccgagcctggcccgccgcgatgctgtagggaccgccgtgtcctc

SEQ ID NO: 1841 - DNA, 59 bp, Homo sapiens
tcctgcgcccctcctagctcccagagagcgtggatcgcgggcggggctcaccgagcgag

SEQ ID NO: 1842 - DNA, 575 bp, Homo sapiens
tcaggtgggctacctaccatcagtggaggaaatttgacctcttcccatttttttggcattaacatggactgtattcatcaaggtattataccacagcactctatggaaatctcaagattagaaaaaaaaaaagaaccaagttatagagttagtttttattttatttttgcacttcgtcatgacagtatagagtttgtttttaatgtctcataaatgacaagtggcaaattcaaatcaactcatataaaactcattctattttttctctaaaatagatctttatatggcttcatgaagtcttttatgtgttttgaatttacataaatgaaagtctcataaaatatcataaagatattttggatcgatttctaaagatgtgactcttcaacggaggagaatagggctctgagaaatggaatcactgaaaaagaaacctgggttctctgatctatccacacagaactagagcaaggaggtgatgaaatactgatctctttcctcacataagtctgagcctaccaatatggatgtactcaaagtgaaacgctgccctgttctctgcttgaccattgtta

SEQ ID NO: 1843 - DNA, 76 bp, Homo sapiens
agactattctagttttctatcaagaaaaagcaagattaagatagctaaagatgactgcgtttttgggaacataaag

SEQ ID NO: 1844 - DNA, 136 bp, Homo sapiens
tggtgactgaacaattcaagatgtgctagagagtagtaaatcaaagcaataaaagaatcaaggaaactctttttaaaagagtaatataataaaatccaacctctcaggcaggatggaccctcttaggctgagatta

SEQ ID NO: 1845 - DNA, 83 bp, Homo sapiens
gaactctgctggatacggatgggccccagagaactctcaaccagaacttagagctcagatttcaatacagtgaggatagttgc

SEQ ID NO: 1846 - DNA, 74 bp, Homo sapiens
cgggaggtacggcactatggatacctgcagctggatccttgtacctgtgactacccagaatcaggctctggagc

SEQ ID NO: 1847 - DNA, 59 bp, Homo sapiens
catccctcgactccgtgctgatggactgcagggtggcggtagatttgctctacatgcag

SEQ ID NO: 1848 - DNA, 41 bp, Homo sapiens
actttgaactcccttatgttagtcttggaagttctgaggtg

SEQ ID NO: 1849 - DNA, 76 bp, Homo sapiens
gtgtcacacaaaattggactgtgtcgagagctcttgggctacttcggcctctttctcattcggtttggcaaggagg

SEQ ID NO: 1850 - DNA, 90 bp, Homo sapiens
atttgacatcgccaccaagaaagcttatctggacatatttctgcccaatgaacagagtattagaatcgaaattataacatcagacactgc

SEQ ID NO: 1851 - DNA, 26 bp, Homo sapiens
aaaaatcagggatatgggctttaggg

SEQ ID NO: 1852 - DNA, 46 bp, Homo sapiens
atggacccaaacgtgttgagaagtgatgtcttcgttgagtttttaa

SEQ ID NO: 1853 - DNA, 76 bp, Homo sapiens
cttcccaccaaagtactatctggcaatgaccacagctatggctgatgagaggagggaccaactggaacaatatttg

SEQ ID NO: 1854 - DNA, 52 bp, Homo sapiens
tgcatttctgtatcccggtgtcccagcagcggtccgacgcgctggggggccg

SEQ ID NO: 1855 - DNA, 106 bp, Homo sapiens
ttcgctctgagtcgcgtggcaggccgcgctgcgtccaccgctgccgagttcagagccgcgcaccgcccgccgccgcaggtcgggttcccagcgctactcccaagac

SEQ ID NO: 1856 - DNA, 35 bp, Homo sapiens
ctcccaagtagtccacttcattcttcacctctgga

SEQ ID NO: 1857 - DNA, 227 bp, Homo sapiens
ccagttgtactgtcgagaaaagagctatttctgtcttttaactctcaaatacaaagatactgctcagtgggaatcaaacattcctaattttcatttatttatcttttcattttaattttggattggggggggtatctgcgcagctctgttagacggagtatattgcatggtgctgaggtctgggcttctgatggtcccgtcgttcaagtagcaaacgcgctgcgcga

SEQ ID NO: 1858 - DNA, 357 bp, Homo sapiens
tgacaccgccatgaaaacgatcagcaccgtcgaatcctcacgccccactcaagttccttgattgcttcaataatgtcctccgtagcaaaaggatctagttcaaaatcgggagttacatttcattgtcatgcctaaaacgtaagaattgctcattcactttggagcagttcttcagtctatccttgattttcatgaccttgacacttttgaacattatagaccagttattcaatagaatatctttcaatctgggtttgtccgatacctctttattattagattgaaatgatacattttggtggaactatcacagaattgacattgcattcttctcattacatcctgtctggtggcctg

SEQ ID NO: 1859 - DNA, 214 bp, Homo sapiens
ccttatgtaccgagcaaatgccaggtctagcaaacataatgctagtcctagattacttattgatttaaaaacaaaaaaacacaaaaaaatagtaaaatataaaaacaaattaatgttttatagaccctgggaaaaagaattttcagcaaagtacaaaaatttaaagcattcctttctttaattttgtaattctttactgtggaatagctcagaa

SEQ ID NO: 1860 - DNA, 77 bp, Homo sapiens
tgatcagggaccatgaaaagaaacttgtgcttcaccgaagaaaaatatctaaacatcgaaaaacttaaatattatgg

SEQ ID NO: 1861 - DNA, 87 bp, Homo sapiens
atgaagctgtagctgtactacaagcccaccaagctaaagaggctgcccagaaagcagttaacagtgccaccggtgttccaactgttt

SEQ ID NO: 1862 - DNA, 25 bp, Homo sapiens
gccatgcaccctactcttgctggta

SEQ ID NO: 1863 - DNA, 25 bp, Homo sapiens
tcctcaagagcaaaagcaaatgttg

SEQ ID NO: 1864 - DNA, 25 bp, Homo sapiens
aatgggtccacgtcctgcagctgca

SEQ ID NO: 1865 - DNA, 67 bp, Homo sapiens
tgcaaacctcagatcgaagaagacagcataaacacttttcactcagtaagttttcccagttaatgta

SEQ ID NO: 1866 - DNA, 25 bp, Homo sapiens
aaccgtgctgcatactatcctccta

SEQ ID NO: 1867 - DNA, 26 bp, Homo sapiens
ttatgatggagggtggtcgcagcaaa

SEQ ID NO: 1868 - DNA, 46 bp, Homo sapiens
gatgatggtattgatgatgaacgtctccggaaagagttttctccat

SEQ ID NO: 1869 - DNA, 89 bp, Homo sapiens
ttatgttggtcgagctcagaaaaaggtggaacggcagacggaacttaagcgcaaatttgaacagatgaaacaagataggatcaccagat

SEQ ID NO: 1870 - DNA, 73 bp, Homo sapiens
tttgttggacgatttaagtctcgtaaagaacgagaagctgaacttggagctagggcaaaagaattcaccaatg

SEQ ID NO: 1871 - DNA, 57 bp, Homo sapiens
tgaaaatggttccaagggctatggatttgtacactttgagacgcaggaagcagctga

SEQ ID NO: 1872 - DNA, 100 bp, Homo sapiens
gctacatttagtttagtgcttgaaataggaactgtgcagtaatggatatctttatttcacaaatatccaggttagatggctaacagattgtctctcaaca

SEQ ID NO: 1873 - DNA, 29 bp, Homo sapiens
ggagcgtgctttggacaccatgaattttg

SEQ ID NO: 1874 - DNA, 104 bp, Homo sapiens
ctacgagaagttcagcccggccgggcccatcctctccatccgggtctgcagggacatgatcacccgccgctccttgggctacgcgtatgtgaacttccagcagc

SEQ ID NO: 1875 - DNA, 27 bp, Homo sapiens
gtcgcggcctgtggccctgcgggcagc

SEQ ID NO: 1876 - DNA, 32 bp, Homo sapiens
cccggcactcgctctcctcctctcacggaaag

SEQ ID NO: 1877 - DNA, 36 bp, Homo sapiens
gatttttgtccctctgcgcttgctccccgctcccct

SEQ ID NO: 1878 - DNA, 46 bp, Homo sapiens
tcgctccccgccggcagccggcagccagcggcagtggatcgacccc

SEQ ID NO: 1879 - DNA, 57 bp, Homo sapiens
ccaagaaggaaccaagagaccgaggccttcccgctgcccggacccgacaccgccacc

SEQ ID NO: 1880 - DNA, 656 bp, Homo sapiens
gctggctccatctacgcacgtttcggaaaccgggcccggaggggaccacgcccgctcacccgtgcccggcgtcccccggagctggggctagaggagccgggccggccgcagcgggaagaggccacaggcggccgcgcacgtggggggtggttagcgcggaggaacccggaagccctttgcaccgcccaccgccgcggtgacgggttaacgctcctcctggtggaggcaggggcgggcggggcggaaggcggggacgcctcagccaacacccccgaggaccgcccgcgagccgtcctccccacccccacggacgcgacgcagcgcgggctccgcttccccggccgcggcgcctgcgcaaaagccccgccccttcgcccgagccccacccccacaccgcagcctccaccgccgccacctctcccttcctctctgctctttcctcctgttttctcttccctcctccccctggcctccgcgtctcctcctactccggcgctgacgctcgcgtaggggccctggcgtcagacgcgcgggggcggggcgagtgcggcgcggggtataagtagagggtgcaggaggcggtgcttccccttctccccggcggttagtgctgagagtgcggagtgtgtgctccgggctcggaacacacatttatt

SEQ ID NO: 1881 - DNA, 65 bp, Homo sapiens
aggcaccgcttctgcggccgacgcgcgtggcggcggtgccggctgggactcgtagtgcggtccgg

SEQ ID NO: 1882 - DNA, 89 bp, Homo sapiens
gatcggggcaagagaggctgagtacggatgggaaactattgtgcacaagtctttccagaggagtttcttaatgagatatttgtatttat

SEQ ID NO: 1883 - DNA, 155 bp, Homo sapiens
gctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgc

SEQ ID NO: 1884 - DNA, 1154 bp, Homo sapiens
aggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggtggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatgg

SEQ ID NO: 1885 - DNA, 186 bp, Homo sapiens
ttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctc

SEQ ID NO: 1886 - DNA, 42 bp, Homo sapiens
ctcggctagcatgacccgcctgatgcggtcccgcacagcctc

SEQ ID NO: 1887 - DNA, 356 bp, Homo sapiens
aattcgtgtgtcctcccttactaggaagttattgaacttctgatcccttttatcatttccttaaactgtttgcccatgtatagtaagagtatgcttggtaagctgactgcagtcctagcattggccttagccatgattagctctagcaaggcgaggctggcaggtttgatttccatgcctcaggctcaggcaggatccacatccccaggtgccctcttccaacagaagctatctgctagtggggctcctgcctttctagcctgctttccccgacggaagttgcaggcaaaggttgtcattggagacagccatggagacagccgcggggcagtcctgctttaccctgcacggtgtga

SEQ ID NO: 1888 - DNA, 61 bp, Homo sapiens
gcatgtgtcggaattggaagtgctctgtcctgagccaggtttggatgagcaattctgtgtc

SEQ ID NO: 1889 - DNA, 29 bp, Homo sapiens
caagtacttcgtgcagggcatgggataca

SEQ ID NO: 1890 - DNA, 28 bp, Homo sapiens
atggcggactgtggcggcctcccgcaga

SEQ ID NO: 1891 - DNA, 46 bp, Homo sapiens
ggagtgcaactcaaaattggacccaacaaagaccactctcctcaag

SEQ ID NO: 1892 - DNA, 35 bp, Homo sapiens
ggtggttggggacagctcgcctgcagtggatgccg

SEQ ID NO: 1893 - DNA, 121 bp, Homo sapiens
gcgcaaagagatcctgtgttctccccaaggccacacagctagaaagtggcagagcatgatttggatcctgcttgtctaactccaggctgtgagctgggaaagagcttctcatgttgggagc

SEQ ID NO: 1894 - DNA, 68 bp, Homo sapiens
tgcagagtaacgtggaagtggtccacacctaccgccagcacattgtgaatgacatgaaccccggcaac

SEQ ID NO: 1895 - DNA, 28 bp, Homo sapiens
atggacccaagctctgccggacatggtg

SEQ ID NO: 1896 - DNA, 837 bp, Homo sapiens
aggagcccttccgtccagcctgtatgacgttctggagtggaacacactccctgttttttatttgattttccagcaaaggaagtgacattccagtcaacccgctgggcttcatgatagctgtcctgagtgagactcgaaggtctggggatgtcgaccactggctaatgtgaagcctgaggattgtctttaatagctgtactattcccttcagtacagctttaatagctgtactattcccttctttttcaactccagcctttcgattaccaggcattggtattagatactgtgatgtgtgcagttacttcttgcagtccttcccttgaccttgtggccttgaagttcctggcactcccagttccagattagaagtctgagacccagaggtatgcagactgcccagtgccacacagctaggctgtggcaggcaagggccagccaaagacccttaggtctagagcttctctcctactcatttttgcctaatgcttaggtcagcacacatttatggagcttctgctgtatactaggacttatagagctcctgctgcaaacctagtcactggggagaggtaggaaaagaagattgtcagtgtctttggtaatatcagtatacttagaaaggggaaactggcttggagatgagagaggagggatagttgggagccaagcatatcttggggtatagactggggagctcagtgtgtttttagaagaggtgaatggatggccctctttgctgaggacttggtgaatgtttggagcagggtaagctagcagtagctgggtctttattcagcacttatttgctgtgcatcttgtgcatgggcctctgaa

SEQ ID NO: 1897 - DNA, 46 bp, Homo sapiens
tggagggccttgtccttatcaacgtgaacccttgtgcggaaggctg

SEQ ID NO: 1898 - DNA, 28 bp, Homo sapiens
ctgaaaagcattattggcatgggaacag

SEQ ID NO: 1899 - DNA, 109 bp, Homo sapiens
tggtttctagcatcttcctgccccttggctttgatctggactgaccactaaaattaaggttgcaatttagagatgaggcaagaaattagctcgtcactctgtgaacact

SEQ ID NO: 1900 - DNA, 27 bp, Homo sapiens
gcttcctggagtccttcaacagtttgg

SEQ ID NO: 1901 - DNA, 65 bp, Homo sapiens
acccagcactttgccgtctgccacgtggacgcccctggccagcaggacggcgcagcctccttccc

SEQ ID NO: 1902 - DNA, 65 bp, Homo sapiens
ccgagacacctaatttttttctcatcttacttttttctcttctctccctcactgctgttcttcag

SEQ ID NO: 1903 - DNA, 103 bp, Homo sapiens
agcaggacatcgagactttacatggctctgttcacgtcacgctgtgtgggactcccaagggaaaccggcctgtcatcctcacctaccatgacatcggcatgaa

SEQ ID NO: 1904 - DNA, 25 bp, Homo sapiens
cccactgtctgctgtgtctcctcag

SEQ ID NO: 1905 - DNA, 43 bp, Homo sapiens
tctcgggagatgcaggatgtagacctcgctgaggtgaagcctt

SEQ ID NO: 1906 - DNA, 78 bp, Homo sapiens
ggcgatgagacggtccgaaaaaataccaggatagcgtttcctggcgtcgtctccgaatcccagctggcgccgctggca

SEQ ID NO: 1907 - DNA, 79 bp, Homo sapiens
cggagctgcaagtgcgcggtcaccccggggcgcgggcgcgagggggctttgggtgcagacaccgctgaagtggggggtt

SEQ ID NO: 1908 - DNA, 49 bp, Homo sapiens
aggggccgcccgtgcggtgccgctggagcgccaggaccgccctttgtag

SEQ ID NO: 1909 - DNA, 25 bp, Homo sapiens
gtaagcccgcgccctcttctcccag

SEQ ID NO: 1910 - DNA, 263 bp, Homo sapiens
gcttgcgcaacaggcggcggctccagtgggcgcccgccgcgcgctgccggagcccagcccagcccggcgcgcccgggaggagggagcagggagcggggaaggggtgtgtcccggctgcgtgctgggactgcgagggtctgggaggggcgaggcgcgggggcggggccgcggcgcctataaagtcgccctccgcccggacgtaaacaaacctcgcctggctcccagctggtgctgaagctcgtcagttcaccatccgccctcgg

SEQ ID NO: 1911 - DNA, 130 bp, Homo sapiens
atggacgagattaaacgggagcgaggatttcagcgagagctttggcgacacggaaggctgagaatcggagggagcctgtcgggcgaaagcgaaggcggctgctgggcaggcagccgaatccggctggaga

SEQ ID NO: 1912 - DNA, 30 bp, Homo sapiens
tggtcagtgtcctgtctgcggttacgacgt

SEQ ID NO: 1913 - DNA, 26 bp, Homo sapiens
aagttctggcccaatgagaaatgggc

SEQ ID NO: 1914 - DNA, 30 bp, Homo sapiens
gaagacagccaagggagttcgaatagttgg

SEQ ID NO: 1915 - DNA, 171 bp, Homo sapiens
ctcctcctccctaatgtgtctgtggaccacctggattccactgtacaaggggaaaagtgtctattcctttcccaaagatggaaaatggagggcttagggacactagatgcatctttctcagcatcacttccagatgcagtgacttgttgggctgcgtccttaatggccatg

SEQ ID NO: 1916 - DNA, 144 bp, Homo sapiens
gaaggcagccaattactaacttctggttgctaggtgtggcttcctttaaaatcctataaaatcagaagcccaagtctccactgccagtgtgaaatcttcagagaagaatttctctttagttctttgcaagaaggtagagataaa

SEQ ID NO: 1917 - DNA, 101 bp, Homo sapiens
catattcgaggaaaaactatgcacaaggccgtgcatttaaaaataaactccctaaggctggggtgaaacctgctacggtctgcgcaagttgactgttaatg

SEQ ID NO: 1918 - DNA, 386 bp, Homo sapiens
cagccagggcctactctaagaagtttctttagcccttatgttttcctatggagagcacacactagctttaagtcctgagggtacttaagatgatatttcaatgtttttgtactcttagtgcttggcatatggtgggtggtctacaaatttagaacaatgtagtgaaccacaaactcctctcttcagcctgtgtgcttacttgtagtagttgtctgatctctaaaatttagaactgaatatgccaagaaagagttcaatttcagagaggagggtatggtttcattttaagtataaaagcttcctttaaaaaaaattacgtcttacattttgttatgctcctaagtgtaattgatcctggaaagtaagcgcaaggctactctctaatg

SEQ ID NO: 1919 - DNA, 41 bp, Homo sapiens
ggtatcagaattcctcaagcaggcctggtttattgaaaatg

SEQ ID NO: 1920 - DNA, 91 bp, Homo sapiens
gtcatccaaaggtggtcccggatcagcggtgagcccctatcctaccttcaatccatcctcggatgtcgctgccttgcataaggccataatg

SEQ ID NO: 1921 - DNA, 74 bp, Homo sapiens
ggatgaagcaaccatcattgacattctaactaagcgaaacaatgcacagcgtcaacagatcaaagcagcatatc

SEQ ID NO: 1922 - DNA, 248 bp, Homo sapiens
cttaaccatggattcggaagcacagttacctagttctttaaggttctaaccactgttttctcattacatctatgattgggattgcagtgtttatccactttgttgcaatttaatcaattttatcaaatttcctatttttatacattagtcatcttggtgtatattgtttgcagatgtggtgctctggggacaaatttttaatttgaacgtaaacatcgagattgctgctgtcaataaagaatatggtc

SEQ ID NO: 1923 - DNA, 25 bp, Homo sapiens
cccctggatgaaacactgaagaaag

SEQ ID NO: 1924 - DNA, 87 bp, Homo sapiens
cccttacaggtcaccttgaggaggttgttttagctctgctaaaaactccagcgcaatttgatgctgatgaacttcgtgctgccatga

SEQ ID NO: 1925 - DNA, 72 bp, Homo sapiens
agatactctaattgagattttggcatcaagaactaacaaagaaatcagagacattaacagggtctacagaga

SEQ ID NO: 1926 - DNA, 70 bp, Homo sapiens
tgaagagagatctggccaaagacataacctcagacacatctggagattttcggaacgctttgctttctct

SEQ ID NO: 1927 - DNA, 32 bp, Homo sapiens
gtgaccgatctgaggactttggtgtgaatgaa

SEQ ID NO: 1928 - DNA, 32 bp, Homo sapiens
gggacagacgtaaacgtgttcaataccatcct

SEQ ID NO: 1929 - DNA, 60 bp, Homo sapiens
caccaagtacagtaagcatgacatgaacaaagttctggacctggagttgaaaggtgacat

SEQ ID NO: 1930 - DNA, 27 bp, Homo sapiens
tgaagtgcgccacaagcaaaccagctt

SEQ ID NO: 1931 - DNA, 416 bp, Homo sapiens
gctaggtactgctctgtagtggttagcatagttgctgccccctttctgccatagtctagtgtgatatttcgttgggtaatgatgaatacctggtgccatggaagagaaaagtgggacatatactccagactttggaaatccaggtagcattgctgtcagctaaattaacacctgaagtttaaatagaaatgagccagatgagggcaagagtggaagagatggggataaagcaagggtggtccaagaggaagaagtaacccacacacaggcttgaaggcaaaaggtaacataaccttctcaagacagtaagtatagagtgatggtgcacactggaagagatggtagaattaggcaggatattgtaagccttgaaaaagaattaggcaggatatcggaagccctgattagattctatc

SEQ ID NO: 1932 - DNA, 108 bp, Homo sapiens
cgccataaggcattgatcaggattatggtttcccgttctgaaattgacatgaatgatatcaaagcattctatcagaagatgtatggtatctccctttgccaagccatc

SEQ ID NO: 1933 - DNA, 52 bp, Homo sapiens
gatgaaaccaaaggagattatgagaaaatcctggtggctctttgtggaggaa

SEQ ID NO: 1934 - DNA, 127 bp, Homo sapiens
acattcccttgatggtctcaagctatgatcagaagactttaattatatattttcatcctataagcttaaataggaaagtttcttcaacaggattacagtgtagctacctacatgctgaaaaatatag

SEQ ID NO: 1935 - DNA, 30 bp, Homo sapiens
cagaacccgcagcgccggcctggcagggca

SEQ ID NO: 1936 - DNA, 78 bp, Homo sapiens
cgccgccagcccgcttgcagggtccccattggccgcctgccggccgccctccgcccaaaaggcggcaaggagccgaga

SEQ ID NO: 1937 - DNA, 89 bp, Homo sapiens
ttccctccgcggaggggactcggcaactcgcagcggcagggtctggggccggcgcctgggagggatctgcgccccccactcactcccta

SEQ ID NO: 1938 - DNA, 55 bp, Homo sapiens
tagtctccggcgctggcgcctatggtcggcctccgacagcgctccggagggaccg

SEQ ID NO: 1939 - DNA, 34 bp, Homo sapiens
ctgggcgagggcttcattcttccgcggcgtccct

SEQ ID NO: 1940 - DNA, 43 bp, Homo sapiens
gagcggtggtgatggtctgggaagcggagctgaagtgccctgg

SEQ ID NO: 1941 - DNA, 46 bp, Homo sapiens
aggaaaacgtggatgattactacgacaccggcgaggaacttggcag

SEQ ID NO: 1942 - DNA, 215 bp, Homo sapiens
cagtttgcggttgtgaagaaatgccgtgagaaaagcaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttgga

SEQ ID NO: 1943 - DNA, 63 bp, Homo sapiens
cctgagaacataatgcttttggatagaaatgtccccaaacctcggatcaagatcattgacttt

SEQ ID NO: 1944 - DNA, 49 bp, Homo sapiens
ctcctgagatagtcaactatgaacctcttggtcttgaggcagatatgtg

SEQ ID NO: 1945 - DNA, 25 bp, Homo sapiens
gagtatcggggtaataacctatatc

SEQ ID NO: 1946 - DNA, 84 bp, Homo sapiens
gaaacgttagcaaatgtatccgctgtcaactacgaatttgaggatgaatacttcagtaataccagtgccctagccaaagatttc

SEQ ID NO: 1947 - DNA, 32 bp, Homo sapiens
tgacaattcaagatagtttgcagcatccctgg

SEQ ID NO: 1948 - DNA, 86 bp, Homo sapiens
cctaaagatacacaacaggcacttagtagaaaagcatcagcagtaaacatggagaaattcaagaagtttgcagcccggaaaaaatg

SEQ ID NO: 1949 - DNA, 91 bp, Homo sapiens
aatccgttcgcttgatatcactgtgccaaagattatccaggtcattcctgtccagaagtaacatgagtgttgccagaagcgatgatactct

SEQ ID NO: 1950 - DNA, 105 bp, Homo sapiens
agactcctttgtgatgaaagccatcatccatgccatcaacgatgacaatgtcccaggcctgcagcaccttctgggctcattatccaactatgatgttaaccaacc

SEQ ID NO: 1951 - DNA, 60 bp, Homo sapiens
gggtccaatgccgtctactgggctgctcggcatggccacgtcgataccttgaaatttctc

SEQ ID NO: 1952 - DNA, 81 bp, Homo sapiens
tccacgtggcagctcgctatggccatgctgacgtggctcagttactgtgcagcttcggctcaaatcccaatatccaggaca

SEQ ID NO: 1953 - DNA, 161 bp, Homo sapiens
tgctgcttggcacggctattactctgtggccaaagccctttgtgaagccggctgtaacgtgaacatcaagaaccgagaaggagagacgcccctcctgacagcctctgccaggggctaccacgacatcgtggagtgtctggccgaacatggagccgacctta

SEQ ID NO: 1954 - DNA, 165 bp, Homo sapiens
cttcatctggctgtaagacggtgtcagatggaggtaatcaagactctcctcagccaagggtgtttcgtcgattatcaagacaggcacggcaatactcccctccatgtggcatgtaaagatggcaacatgcctatcgtggtggccctctgtgaagcaaactgcaat

SEQ ID NO: 1955 - DNA, 301 bp, Homo sapiens
cagttccctgggttaccttggcacacaatttgggaaccataggcacaaacaaggcttatgggcttgtcctggtattttcactaattaggatgtcttcaatatctgtcttccatgtcttcttccctggctgtgtctaaatttgaactatggtgcagatcttgctggaactctggaccttgagcccttgactcctgtctctttcaggccagcacagcaggaaacttacttaagttatctttgaagttgtattttgaagctcctcttttaattgcaaagtacttggaaaggttctgcctggctg

SEQ ID NO: 1956 - DNA, 66 bp, Homo sapiens
tccttaaccttgtgtctccggaatgtcatcctcagcaactgcgtgagaagaacgacctttggcctt

SEQ ID NO: 1957 - DNA, 121 bp, Homo sapiens
cctctcaggggtgacttcaaggactgaggcttgcagagagcactgagagctgggtcgagcacatattatgaggtggtgttcaataaatacttgctgtcatcgtgtatgttcatggtgtaga

SEQ ID NO: 1958 - DNA, 70 bp, Homo sapiens
tggcttgcttctcacacctgctatgcttgtttctgcctcagacccacggaattggcgtatggaacacaca

SEQ ID NO: 1959 - DNA, 70 bp, Homo sapiens
acggaaagacggcagaagatcttgctagatcggaacagcacgagcacgtagcaggtctccttgcaagact

SEQ ID NO: 1960 - DNA, 140 bp, Homo sapiens
ctctagacagccaggttttaggaacagtggtccctgtcctgtggtttacatgtcagtcggtataaatgcatcagctccctatctgttttcttctctatttggacttggaaatcatttagcatgtttgcagttgccgtgcc

SEQ ID NO: 1961 - DNA, 156 bp, Homo sapiens
accgaggactcttcatccagcagctccgacccacacagaacctgcagccaagaattaagctcaagctgtttggccactcgggatccgggaaaaccacccttgtagaatctctcaagtgtgggctgctgaggagctttttcagaaggcgtcggccca

SEQ ID NO: 1962 - DNA, 30 bp, Homo sapiens
tctcagtgagcatcaacaacctgtacccag

SEQ ID NO: 1963 - DNA, 131 bp, Homo sapiens
aggagccgcagcatgatgttcgagccgggtcttaccaaagggatgctggaggtgtttgtggccccgacccaccacccgcactgctcggccgatgaccagtccaccaaggccatcgacatccagaacgctta

SEQ ID NO: 1964 - DNA, 190 bp, Homo sapiens
cgatttcagcgtgtgggagttctctggaaatcctgtgtatttctgctgttatgactattttgctgcaaatgatcccacgtcaatccatgttgttgtctttagtctagaagagccctatgagatccagctgaaccaagtgattttctggctcagtttcctgaagtcccttgtcccagttgaagaacccata

SEQ ID NO: 1965 - DNA, 114 bp, Homo sapiens
ccttgtggcctaggagataggcttatcctgtcgttggccatgctggggccttctagggtcacagtgcacagcaggcgtggggccttcatctctgtggcatgttgcacttgtacc

SEQ ID NO: 1966 - DNA, 87 bp, Homo sapiens
tggccacccacgctgacatcatgaatgttcctcgaccggctggaggcgagtttggatatgacaaagacacatcgttgctgaaagaga

SEQ ID NO: 1967 - DNA, 35 bp, Homo sapiens
aaggacatgaaggtacttcgaaatcatctgcaaga

SEQ ID NO: 1968 - DNA, 32 bp, Homo sapiens
cgaggaggacctcaggcgcattgctcagcagc

SEQ ID NO: 1969 - DNA, 454 bp, Homo sapiens
ctcctgaccgtgaagcattacctgagcccccagcagctgcgggagcaccatgagcccgtcatgatctaccagccacgggacttcttccgggcacagactctgaaggaaacctcactgaccaacaccatgggggggtacaaggaaagcttcagcagcatcatgtgcttcgggtgtcacgacgtctactcacaggccagcctcggcatggacatccatgcatcagacctgaacctcctcactcggaggaaactgagtcgcctgctggacccgcccgaccccctggggaaggactggtgccttctcgccatgaacttaggcctccctgacctcgtggcaaagtacaacaccagtaacggggctcccaaggatttcctccccagccccctccacgccctgctgcgggaatggaccacctaccctgagagcacagtgggcaccctcatgtccaaactga

SEQ ID NO: 1970 - DNA, 707 bp, Homo sapiens
tagtgtacctcctctcagtgttttggactccatctctcatcctccagtaccttgcttcttactgataattttgctggaattcctaacttttcaatgacattttttttaactactatattgattgtcctttaaaaaagaaaagtgcatatttatccaaaatgtgtatttcttatacgcttttctttgttataccatttcctcagcttatctcttttatatttgtaggagaaactcccatgtatggaatcccactgtatgatttataaacagacaatatgtgagtgccttttgcagaagagggtgtgtttgaaatcatcggagtcagccaggagctgtcaccaaggaaacgctacctctctgtcccttgctgtatgctgatcatcgccagaggtgcttcaccctgagttttgttttgtattgttttctgacagtttttctgttttgtttggcaaggaaaggggagaagggaatcctcctccagggtgattttatgatcagtgttgttgctctaggaagacatttttccgtttgcttttgttccaatgtcaatgtgaacgtccacatgaaacctacacactgtcatgcttcatcattccctctcatctcaggtagaaggttgacacagttgtagggttacagagacctatgtaagaattcagaagacccctgactcatcatttgtggcagtcccttataattggtgcata

SEQ ID NO: 1971 - DNA, 125 bp, Homo sapiens
aagaagttgacactccgattttccacatcatctaactaaaatggatttaaactaactttctctaactattaaatctttcttaggtaagtacagttgtatcccagctctagagttaatgtgctggg

SEQ ID NO: 1972 - DNA, 37 bp, Homo sapiens
cgctcttgttgcgtgtgttcaaacaaccggcacggtc

SEQ ID NO: 1973 - DNA, 27 bp, Homo sapiens
tcggtctgttgcccaggcgggtgtgca

SEQ ID NO: 1974 - DNA, 431 bp, Homo sapiens
cccgatcgggaaactctgctgtcaactaagcaaactctaaatttaacatttgggggacccccttggagagtagttgagagctatgtgctccccttttcagaaaaatgctctcaaatactcagtgcataagcccacagccttagcaggttcccagaccttaggtcagcaatcctgttctaaggcatacatcacgagcagcattttgattttcatctggggaacttatagttcataaagacctactgatccattaaaatttccacttgattttgccattagtaatctcttaaacaagtccaaggaagccagaggaagttatttcttgaatgcttttatactagtgctttcaagagttcgtgttgctgactccagtttttaaaattattattctcatcttctgcaatgcctcgaggcatgtttttagctgaata

SEQ ID NO: 1975 - DNA, 45 bp, Homo sapiens
cccagccaggctatggttgccaccccaacccaataaaactgatgt

SEQ ID NO: 1976 - DNA, 42 bp, Homo sapiens
gccaaggaggagaacgtcgagattcaccagaccttggaccag

SEQ ID NO: 1977 - DNA, 152 bp, Homo sapiens
ctctatgaccccaaggccttgagtgaggcatccacgtccgtcctgttcccctcatcctagtcagtccatctgtttgtccctgccaaggggccctgaggtccgtgaatgcatgtgtcttccttgacccactccatgtctatatgtcaccttcc

SEQ ID NO: 1978 - DNA, 352 bp, Homo sapiens
acggagcactggttcactcctgacaccctggcacttactgacacccccagcccctgcactgagcccacccacaaaacaccatggcccacgctgaaacccctctgcacaggcactccctggctgtcgctctctgattcaccactgcatgtgggcacgtgtggccccatcaaaccatgaccgcctctggtgccaatccctgacctcagagcacttagctggggttccaggatcaaacagagtgactggaaaggaagtagggtggtgaggtgcaggacaggggcaagaaggttgcaaaaggtctggaatggagcttggaaaaatgttggatatcagcaacatggggctttcactg

SEQ ID NO: 1979 - DNA, 31 bp, Homo sapiens
tcctttgctgcttaataaattctgaacttgg

SEQ ID NO: 1980 - DNA, 101 bp, Homo sapiens
ccacgccagcgtggccacctcagctctcttctctcctctcctttccattctctctatggggaggggagcaggcaggaggagcagaaattgccaacattgca

SEQ ID NO: 1981 - DNA, 33 bp, Homo sapiens
aggaactggacaacgcactcaatgacatcacct

SEQ ID NO: 1982 - DNA, 29 bp, Homo sapiens
gacccgagcagagtttgccgagaggtctg

SEQ ID NO: 1983 - DNA, 26 bp, Homo sapiens
gaagaggagatcaaactgttggagga

SEQ ID NO: 1984 - DNA, 82 bp, Homo sapiens
caagatgaccaggagcctacggggtacaatggagaaatgaaggatctgtggtagcgctgtactgatggcgtgtgtgtgtccc

SEQ ID NO: 1985 - DNA, 25 bp, Homo sapiens
tgaaaattgttaccaacaacttgaa

SEQ ID NO: 1986 - DNA, 206 bp, Homo sapiens
tttctgggcaatggcgccttctctcagctcaccttccctccgtctcagcaccgcaggctgctctttctcagctgctggggatcaggaagggcctggggcttctgagccctgcctgctgtcactctcacaactttgctcttctcttctctcctccacccgtcccctgctgtgccatctccactgtctggcttcgctgtgccctcaca

SEQ ID NO: 1987 - DNA, 32 bp, Homo sapiens
tggaggaggaacttcgaaccatggaccaggcc

SEQ ID NO: 1988 - DNA, 70 bp, Homo sapiens
gggtgacaagtgagcccattggccctggggccttccacacagtgggaaggtagcatcctaggcttggggc

SEQ ID NO: 1989 - DNA, 58 bp, Homo sapiens
tggccaggaagctggtgatcctggaaggagagctggagcgctcggaggagagggctga

SEQ ID NO: 1990 - DNA, 29 bp, Homo sapiens
ggaggccaagcacatcgctgaggattcag

SEQ ID NO: 1991 - DNA, 25 bp, Homo sapiens
agaaggcggctgatgagagcgagag

SEQ ID NO: 1992 - DNA, 38 bp, Homo sapiens
gatgtggcctccctgaaccgccgcattcagctggttga

SEQ ID NO: 1993 - DNA, 32 bp, Homo sapiens
agaaactggagcaggccgagaagaaggccact

SEQ ID NO: 1994 - DNA, 27 bp, Homo sapiens
gatgaggtggaaaagtattctgaatcc

SEQ ID NO: 1995 - DNA, 60 bp, Homo sapiens
atcgaccgcgccgagcaggccgaagccgacaagaagcaagctgaggaccgctgcaagcag

SEQ ID NO: 1996 - DNA, 509 bp, Homo sapiens
ttcagcataaagttggcccactgggaaagagaggagcgtccgcggggagcgggggagaagagggaaggcgcgcggaggggagtggggccaggcggagccaggggcggggagcggaggggctcgggacgcgtccgggtgggagcgggggcggggaacgcgcggtgaccagcctggccgcagccgcgtggaaaatatgcggggcacgtggggggcggggcggggagctgggtcctgagccgccgggtgctcgcaggaagggcctggctccaggggcaggggctgggaggggaggcgaggggatgagaggtcaggccggtcctgggggcagcaagcccggccacactccccaccgcgaccggggctctgggctcgcttcctgcttcagtttccccaagctcccgatgagactccgctactaccaccacgtcgataacgcaaacctagagggactcagggtaaactgaggcactcaaactgccgaggagctccgcctcccgagagacatttaa

SEQ ID NO: 1997 - DNA, 389 bp, Homo sapiens
tcatgtcttagagcccgtctttatgtttaaaactaatttcttaaaataaagccttcagtaaatgttcattaccaacttgataaatgctactcataagagctggtttggggctatagcatatgcttttttttttttaattattacctgatttaaaaatctctgtaaaaacgtgtagtgtttcataaaatctgtaactcgcattttaatgatccgctattataagcttttaatagcatgaaaattgttaggctatataacattgccacttcaactctaaggaatatttttgagatatccctttggaagaccttgcttggaagagcctggacactaacaattctacaccaaattgtctcttcaaatacgtatggactggataactctgagaa

SEQ ID NO: 1998 - DNA, 170 bp, Homo sapiens
ctaattcaattgcaagagtgggagtaaatgacttctgtccaacagtgccaaagatgaagaaatctttatacagtgcaataagtttattcaacaacccggtgaaatactgggaaatgcaacctgcaacatttcgttgtgttttgagcagaatgagcgttcagcttgggaac

SEQ ID NO: 1999 - DNA, 117 bp, Homo sapiens
atcacagatatcgaaaatgggagtcttgctaacataccacgtgtgagagaaatacatttggaaaacaataaactaaaaaaaatcccttcaggattaccagagttgaaatacctccag

SEQ ID NO: 2000 - DNA, 86 bp, Homo sapiens
taataatgggatagagccaggggcatttgaaggggtgacggtgttccatatcagaattgcagaagcaaaactgacctcagttccta

SEQ ID NO: 2001 - DNA, 133 bp, Homo sapiens
cctgaacaacaacaagctaacgaagattcacccaaaagcctttctaaccacaaagaagttgcgaaggctgtatctgtcccacaatcaactaagtgaaataccacttaatcttcccaaatcattagcagaactc

SEQ ID NO: 2002 - DNA, 28 bp, Homo sapiens
attccatttgatactcgaatgcttgatc

SEQ ID NO: 2003 - DNA, 60 bp, Homo sapiens
tttgatctgtttccaatgtgtccatttggatgtcagtgctattcacgagttgtacattgc

SEQ ID NO: 2004 - DNA, 92 bp, Homo sapiens
tgtgctcctattattcctggctttgtgctctgccaaacccttctttagcccttcacacatcgcactgaagaatatgatgctgaaggatatgg

SEQ ID NO: 2005 - DNA, 198 bp, Homo sapiens
tggactaatctgtgggagcagtttattccagtatcacccagggtgcagccacaccaggactgtgttgaagggtgttttttttcttttaaatgtaatacctcctcatcttttcttcttacacagtgtctgagaacatttacattatagataagtagtacatggtggataacttctacttttaggaggactactctcttc

SEQ ID NO: 2006 - DNA, 94 bp, Homo sapiens
atgcttggcactccctaaccaaatgctgtctccataatgccactggtgttaagatatattttgagtggatggaggagaaataaacttattcctc

SEQ ID NO: 2007 - DNA, 118 bp, Homo sapiens
gcctgcatccggagaattgcctctacctggaccttttgtctcacacagcagtaccctgacctgctgtgcaccttacattcctagagagcagaaataaaaagcatgactatttccacca

SEQ ID NO: 2008 - DNA, 33 bp, Homo sapiens
tcctgaaggtgtatgagaagcactctgcccagt

SEQ ID NO: 2009 - DNA, 74 bp, Homo sapiens
aaggaggccgtgttagacgtcattcccacagacattcaccagagggcgccggtgatcttgggatcccccgacga

SEQ ID NO: 2010 - DNA, 96 bp, Homo sapiens
attcagctccttatggggcccggtatgtgggctccatggtggctgatgttcatcgcactctggtctacggagggatatttctgtaccccgctaaca

SEQ ID NO: 2011 - DNA, 51 bp, Homo sapiens
cttaacgagggctacgccagggactttgaccctgccgtcactgagtacatc

SEQ ID NO: 2012 - DNA, 115 bp, Homo sapiens
ctgagaaggatgctctgcaaccaggccggaacctggtggcagccggctacgcactgtatggcagtgccaccatgctggtccttgccatggactgtggggtcaactgcttcatgct

SEQ ID NO: 2013 - DNA, 70 bp, Homo sapiens
gtggtctgttttgatccccttgatggatcttccaacatcgattgccttgtgtccgttggaaccatttttg

SEQ ID NO: 2014 - DNA, 115 bp, Homo sapiens
ctggttctaccaacgtgacaggtgatcaagttaagaagctggacgtcctctccaacgacctggttatgaacatgttaaagtcatcctttgccacgtgtgttctcgtgtcagaaga

SEQ ID NO: 2015 - DNA, 146 bp, Homo sapiens
aggcgcccttcgacacggacgtcaacaccctgacccgcttcgtcatggaggagggcaggaaggcccgcggcacgggcgagttgacccagctgctcaactcgctctgcacagcagtcaaagccatctcttcggcggtgcgcaaggcg

SEQ ID NO: 2016 - DNA, 25 bp, Homo sapiens
ccccgcacctgccgcttgcacctgc

SEQ ID NO: 2017 - DNA, 40 bp, Homo sapiens
tgcggccagtgcctactgccctctcttgccgcccgcacct

SEQ ID NO: 2018 - DNA, 222 bp, Homo sapiens
gtaagtattgttaccacacatgggctaagatccccagaggcagactgcctgagttcaattcttggctccaccattcccaagttccctaacctctctatgcctcagtttcctcttctgtaaagtagggacactcatacttctcatttcagaacatttttgtgaagaataaattatgttatccatttgaggcccttagaatggtacccggtgtatattaagtgc

SEQ ID NO: 2019 - DNA, 81 bp, Homo sapiens
ttcaccaaagccaatcatttgaacaaagcggggaatgttgggataggaaaggtaagtagggatagtggtcaagtgggaggg

SEQ ID NO: 2020 - DNA, 28 bp, Homo sapiens
aaacatttctggacagtacctgattgta

SEQ ID NO: 2021 - DNA, 53 bp, Homo sapiens
tacatttcatacaacagaaaccagaaaagcaatactgtttccattttaaggat

SEQ ID NO: 2022 - DNA, 114 bp, Homo sapiens
ccagtgacaacatcgcaatagttttttacttctcttaggtggctctgggaatgggagaggggtaggatgtacaggggtagtttgttttagaaccagccgtattttacatgaagc

SEQ ID NO: 2023 - DNA, 140 bp, Homo sapiens
aaccagcccaaccatcggtccacacctgggcatttggtgagagtcaaagctgaccatggatccctggggccaacggcaacagcatgggcctcacctcctctgtgatttctttctttgcaccaaagacatcagtctccaac

SEQ ID NO: 2024 - DNA, 102 bp, Homo sapiens
ttaactggttccactggaagggccacgaacactcaatccagtttgctgagatgaagctgagaccaagcaacttcagaaatcttgaaggcaggcgcaaacggg

SEQ ID NO: 2025 - DNA, 102 bp, Homo sapiens
cagattcagccatcaccaactgtgctctgtcctacaaaggggctttctggtacaggaactgtcaccgtgtcaacctgatggggagatatggggacaataacc

SEQ ID NO: 2026 - DNA, 99 bp, Homo sapiens
acagcccaggggcagtacgagctccgggtggacctgcgggaccatggggagacagcctttgctgtctatgacaagttcagcgtgggagatgccaagact

SEQ ID NO: 2027 - DNA, 103 bp, Homo sapiens
ccaaggactgctcccaagcaatgctgaatggagacacgacctctggcctctacaccatttatctgaatggtgataaggctgaggcgctggaagtcttctgtga

SEQ ID NO: 2028 - DNA, 109 bp, Homo sapiens
tgggtccagataccacctcctacagcctggcagacctgagcccatccacccactacacagccaagatccaggcactcaatgggcccctgaggagcaatatgatccagac

SEQ ID NO: 2029 - DNA, 89 bp, Homo sapiens
tccaagagacttgactgctactgaggttcagtcggaaactgccctccttacctggcgacccccccgggcatcagtcaccggttacctgc

SEQ ID NO: 2030 - DNA, 146 bp, Homo sapiens
ctggccctaaacctagtatttaatgatccacgttccaggcaggaaaatatttttgaagaggcatattttttaggcaatttttcctagatgtttgttaggtttctatacattgagagctttttacaaactatagcaagcagggaaac

SEQ ID NO: 2031 - DNA, 35 bp, Homo sapiens
gccactgtggacagttatgtcatctcctacacagg

SEQ ID NO: 2032 - DNA, 89 bp, Homo sapiens
ctgtggacggaaccaagactcagaccaggctggtgaaactcatacctggcgtggagtaccttgtcagcatcatcgccatgaagggcttt

SEQ ID NO: 2033 - DNA, 88 bp, Homo sapiens
catcactgaaaattcggctactgtcagctggagggcacccacagcccaagtggagagcttccggattacctatgtgcccattacagga

SEQ ID NO: 2034 - DNA, 255 bp, Homo sapiens
cgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacataacaggtctcagagaggctactgaatacgaaattgaactctatggaataagcaaaggaaggcgatcccagacagtcagtgc

SEQ ID NO: 2035 - DNA, 158 bp, Homo sapiens
cgggttcacagtttcctggatggcatcggagaatgcctttgacagctttctagtaacggtggtggattctgggaagctgctggacccccaggaattcacactttcaggaacccagaggaagctggagcttagaggcctcataactggcattggctatg

SEQ ID NO: 2036 - DNA, 166 bp, Homo sapiens
ccacagttgggcacgctaatctttagcaatattactccaaaaagcttcaacatgtcatggaccactcaagctgggctttttgcaaagattgttatcaatgtgagtgacgctcactcactgcatgagtcccagcaattcacagtctcaggagatgcaaagcaagctc

SEQ ID NO: 2037 - DNA, 102 bp, Homo sapiens
gtgtctcgcagctctgtcatcaccaacctcaaagcttcttctaattacactgcccaccttcatgggctgattggcgggcagcgtgctcagaccctgatggtc

SEQ ID NO: 2038 - DNA, 103 bp, Homo sapiens
tcactgtctcaaacatgacctggggcagtgtgtccatctcgtgggaagctcaggagtctgcctttgatagctttcttatagaagttagtaattccgatcaccc

SEQ ID NO: 2039 - DNA, 229 bp, Homo sapiens
gtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtg

SEQ ID NO: 2040 - DNA, 241 bp, Homo sapiens
cacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagt

SEQ ID NO: 2041 - DNA, 181 bp, Homo sapiens
accgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtca

SEQ ID NO: 2042 - DNA, 150 bp, Homo sapiens
gaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtc

SEQ ID NO: 2043 - DNA, 176 bp, Homo sapiens
gctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagt

SEQ ID NO: 2044 - DNA, 205 bp, Homo sapiens
ctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatcca

SEQ ID NO: 2045 - DNA, 86 bp, Homo sapiens
ctgaggccgggaactgaatatgggattggagtttctgctgtgaaggaagacaaggagagcaatccagcgaccatcaacgcagccac

SEQ ID NO: 2046 - DNA, 140 bp, Homo sapiens
ccagacagataacagcatcaccctggaatggaggaatggcaaggcagctattgacagttacagaattaagtatgcccccatctctggaggggaccacgctgaggttgatgttccaaagagccaacaagccacaaccaaaa

SEQ ID NO: 2047 - DNA, 181 bp, Homo sapiens
cccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctg

SEQ ID NO: 2048 - DNA, 86 bp, Homo sapiens
aggccagagacctcttaccggcaaactggtctagctcctgggcaagagtatgagatatctctgcacatagtgaaaaacaatacccg

SEQ ID NO: 2049 - DNA, 25 bp, Homo sapiens
gatcctctagacattgcttttgaaa

SEQ ID NO: 2050 - DNA, 28 bp, Homo sapiens
aattcaagtccatcaaggagacatctgt

SEQ ID NO: 2051 - DNA, 185 bp, Homo sapiens
tgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgcca

SEQ ID NO: 2052 - DNA, 165 bp, Homo sapiens
ttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggcc

SEQ ID NO: 2053 - DNA, 564 bp, Homo sapiens
ttgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtca

SEQ ID NO: 2054 - DNA, 316 bp, Homo sapiens
ctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgac

SEQ ID NO: 2055 - DNA, 230 bp, Homo sapiens
tccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacaca

SEQ ID NO: 2056 - DNA, 38 bp, Homo sapiens
attctgctgaaagtgagataccctagagccctagagcc

SEQ ID NO: 2057 - DNA, 57 bp, Homo sapiens
tttctatagacacctagctgtgctttcttacaagaaaacatatccactggaccaaag

SEQ ID NO: 2058 - DNA, 64 bp, Homo sapiens
aaccgccgcagctccacactccaggtacttcttccaaggacctaggtctctcgcccatcggaaa

SEQ ID NO: 2059 - DNA, 55 bp, Homo sapiens
ccccgcctccgtgggcacaaaggcagcgctgctggggaactcgggggaacgcgca

SEQ ID NO: 2060 - DNA, 81 bp, Homo sapiens
cgaggcgtcccattacagaggaaggagctcgctatataagccagccaaagttggctgcaccggccacagcctgcctactgt

SEQ ID NO: 2061 - DNA, 72 bp, Homo sapiens
ggaactgatcctcagacaagccaggactcaagtacaagcccatctacaaccagatgagcccttagggccact

SEQ ID NO: 2062 - DNA, 25 bp, Homo sapiens
ttgttcagtatgttgtgctttaatt

SEQ ID NO: 2063 - DNA, 127 bp, Homo sapiens
gtaagaaacggttgaactggatgcaatttttatcacagcttgtgtaagactgcctctgtccctcctctcacatgccattggttaaccagcagacagtgtgctcaggggcgttgccagctcattgctc

SEQ ID NO: 2064 - DNA, 69 bp, Homo sapiens
gttggactggccatccgaagcaagattgcagatggcagtgtgaagagagaagacatattctacacttca

SEQ ID NO: 2065 - DNA, 32 bp, Homo sapiens
gcaattcccatcgaccagagttggtccgacca

SEQ ID NO: 2066 - DNA, 74 bp, Homo sapiens
ccaggtgaggaagtgatcccaaaagatgaaaatggaaaaatactatttgacacagtggatctctgtgccacatg

SEQ ID NO: 2067 - DNA, 25 bp, Homo sapiens
tggatttctgcaagtcaaaagacat

SEQ ID NO: 2068 - DNA, 135 bp, Homo sapiens
gaggacccagtcctttgtgccttggcaaaaaagcacaagcgaaccccagccctgattgccctgcgctaccagctacagcgtggggttgtggtcctggccaagagctacaatgagcagcgcatcagacagaacgtg

SEQ ID NO: 2069 - DNA, 25 bp, Homo sapiens
tagatggcctaaacagaaatgtgcg

SEQ ID NO: 2070 - DNA, 26 bp, Homo sapiens
ttgctggcccccctaattatccattt

SEQ ID NO: 2071 - DNA, 69 bp, Homo sapiens; identical to SEQ ID NO: 2064

SEQ ID NO: 2072 - DNA, 135 bp, Homo sapiens
gaggacccagtcctttgtgccttggcaaaaaagcacaagcgaaccccagccctgattgccctgcgctaccagctgcagcgtggggttgtggtcctggccaagagctacaatgagcagcgcatcagacagaacgtg

SEQ ID NO: 2073 - DNA, 56 bp, Homo sapiens
gattcacatcttggagtagtcacaacttgcagtgccctgattgcttctatttgctt

SEQ ID NO: 2074 - DNA, 26 bp, Homo sapiens
gagagaagacatattctacacttcaa

SEQ ID NO: 2075 - DNA, 26 bp, Homo sapiens
acagtgctctgggaacccaacgacat

SEQ ID NO: 2076 - DNA, 144 bp, Homo sapiens
ccggggtgcccattgcgcagagcgtggcctggagacccgcgagccggggaaggtcgccgtggagtcccgaccagaggccggggttggggtcggtgcagaccgagggctggtttccttgactgtgggagaaacgccgggagccgg

SEQ ID NO: 2077 - DNA, 158 bp, Homo sapiens
ctggcgccgtcttgatactttcagaaagaatgcattccctgtaaaaaaaaaaaaaaaatactgagagagggagagagagagagaagaagagagagagacggagggagagcgagacagagcgagcaacgcaatctgaccgagcaggtcgtacgccgccg

SEQ ID NO: 2078 - DNA, 260 bp, Homo sapiens
gtgacccgaggagggactccgcctccgagcggctgaggaccccggtgcagaggagcctggctcgcagaattgcagagtcgtcgcccctttttacaacctggtcccgttttattctgccgtacccagtttttggatttttgtcttccccttcttctctttgctaaacgacccctccaagataatttttaaaaaaccttctcctttgctcacctttgcttcccagccttcccatccccccaccgaaagcaaatcattcaacg

SEQ ID NO: 2079 - DNA, 25 bp, Homo sapiens
cgagagggcgcgagcacagccgagg

SEQ ID NO: 2080 - DNA, 86 bp, Homo sapiens
gaggtgacggcggaccagccgcgctgggtgagccaccaccaccccgccgtgctcaacgggcagcacccggacacgcaccacccggg

SEQ ID NO: 2081 - DNA, 97 bp, Homo sapiens
atgtgctttttaacatcgacggtcaaggcaaccacgtcccgccctactacggaaactcggtcagggccacggtgcagaggtaccctccgacccacca

SEQ ID NO: 2082 - DNA, 478 bp, Homo sapiens
cctaccctggctggacggcggcaaagccctgggcagccaccacaccgcctccccctggaatctcagccccttctccaagacgtccatccaccacggctccccggggcccctctccgtctaccccccggcctcgtcctcctccttgtcggggggccacgccagcccgcacctcttcaccttcccgcccaccccgccgaaggacgtctccccggacccatcgctgtccaccccaggctcggccggctcggcccggcaggacgagaaagagtgcctcaagtaccaggtgcccctgcccgacagcatgaagctggagtcgtcccactcccgtggcagcatgaccgccctgggtggagcctcctcgtcgacccaccaccccatcaccacctacccgccctacgtgcccgagtacagctccggactcttcccccccagcagcctgctgggcggctcccccaccggcttcggatgcaagtccagg

SEQ ID NO: 2083 - DNA, 117 bp, Homo sapiens
agtgtgtgaactgtggggcaacctcgaccccactgtggcggcgagatggcacgggacactacctgtgcaacgcctgcgggctctatcacaaaatgaacggacagaaccggcccctca

SEQ ID NO: 2084 - DNA, 56 bp, Homo sapiens
agagcagggacgtcctgtgcgaactgtcagaccaccacaaccacactctggaggag

SEQ ID NO: 2085 - DNA, 211 bp, Homo sapiens
aggcatccagaccagaaaccgaaaaatgtctagcaaatccaaaaagtgcaaaaaagtgcatgactcactggaggacttccccaagaacagctcgtttaacccggccgccctctccagacacatgtcctccctgagccacatctcgcccttcagccactccagccacatgctgaccacgcccacgccgatgcacccgccatccagcctgtcc

SEQ ID NO: 2086 - DNA, 71 bp, Homo sapiens
agccctgctcgatgctcacagggcccccagcgagagtccctgcagtccctttcgacttgcatttttgcagg

SEQ ID NO: 2087 - DNA, 175 bp, Homo sapiens
gtgtctgtgttccaaccactgaatctggaccccatctgtgaataagccattctgactcatatcccctatttaacagggtctctagtgctgtgaaaaaaaaaatgctgaacattgcatataacttatattgtaagaaatactgtacaatgactttattgcatctgggtagctgtaa

SEQ ID NO: 2088 - DNA, 71 bp, Homo sapiens
aagaagaaactaggtctgatattcaaatggacaaactgccagttttgtttcctttcactggccacagttgt

SEQ ID NO: 2089 - DNA, 109 bp, Homo sapiens
gttcaaagctgttggcctctgcaaaggaaataccagttctgggcaatcagtgttaccgttcaccagttgccgttgagggtttcagagagcctttttctaggcctacatg

SEQ ID NO: 2090 - DNA, 175 bp, Homo sapiens
tagcttctaagagtccggcggcatctgtcttgtccctattcctgcagcctgtgctgagggtagcagtgtatgagctaccagcgtgcatgtcagcgaccctggcccgacaggccacgtcctgcaatcggcccggctgcctcttcgccctgtcgtgttctgtgttagtgatcactgc

SEQ ID NO: 2091 - DNA, 54 bp, Homo sapiens
gctaacaaaaagtccgcacattcgagcaaagacaggctttagcgagttattaaa

SEQ ID NO: 2092 - DNA, 31 bp, Homo sapiens
ggcccgaccgcacacagcaaggcgatggccc

SEQ ID NO: 2093 - DNA, 45 bp, Homo sapiens
actgagaactagcagcgcgcgcggagcccgctgagacttgaatca

SEQ ID NO: 2094 - DNA, 27 bp, Homo sapiens
gagccctcaatcggcgggacagcaggg

SEQ ID NO: 2095 - DNA, 75 bp, Homo sapiens
ctttcctctgccaccgccgtctcgcaactcccgccgtccgaagctggactgagcccgttaggtccctcgacagaa

SEQ ID NO: 2096 - DNA, 90 bp, Homo sapiens
cccgcgccagagacgcagccgcgctcccaccacccacacccaccgcgccctcgttcgcctcttctccgggagccagtccgcgccaccgcc

SEQ ID NO: 2097 - DNA, 41 bp, Homo sapiens
tccagccggagctacgtgactacgtccacccgcacctacag

SEQ ID NO: 2098 - DNA, 30 bp, Homo sapiens
ctgggcagcgcgctgcgccccagcaccagc

SEQ ID NO: 2099 - DNA, 25 bp, Homo sapiens
gtgcgcctgcggagcagcgtgcccg

SEQ ID NO: 2100 - DNA, 70 bp, Homo sapiens
tgcaggactcggtggacttctcgctggccgacgccatcaacaccgagttcaagaacacccgcaccaacga

SEQ ID NO: 2101 - DNA, 31 bp, Homo sapiens
gcaggagctgaatgaccgcttcgccaactac

SEQ ID NO: 2102 - DNA, 137 bp, Homo sapiens
cagaataagatcctgctggccgagctcgagcagctcaagggccaaggcaagtcgcgcctgggggacctctacgaggaggagatgcgggagctgcgccggcaggtggaccagctaaccaacgacaaagcccgcgtcga

SEQ ID NO: 2103 - DNA, 27 bp, Homo sapiens
gtggagcgcgacaacctggccgaggac

SEQ ID NO: 2104 - DNA, 437 bp, Homo sapiens
aggacgctccgtttcaagttacagatttcttaaaactaccactttgtgtgcagttgaaggcccttgggcacaatgagagccagtcctccaaactttcagaaagtttcctgccccttctggcaggctgccaatcaccgggcgggagaaggaaggaggggaaggcggtggagggagcgagacaaagggatggtccctcgggggcggggatggcggggctgtcctgtaggtctgtgcggccaccgtgattgcccctctgcgcggtgcccgaagtcccgctgaaacctgccgagggcagcaggtctgaaagctgcaggcgctagttgcgcggaggtggcgcagctgctctggaggcgcagagcgaatacgtggtgtttgggtgtggccgccccgcccctggcggtttcctcgttcccctttggttaatgcgcaactgtttc

SEQ ID NO: 2105 - DNA, 28 bp, Homo sapiens
cgaaaacaccctgcaatctttcagacag

SEQ ID NO: 2106 - DNA, 102 bp, Homo sapiens
cacaacccacgagcaattctaaaagttgcttaactcacgtctaaaaagtgcaaaacttcagggctgcgcgtaaagccctctagtggcgggaagaccacaggt

SEQ ID NO: 2107 - DNA, 147 bp, Homo sapiens
cagtcatgattgagtgcagtttaccatgtgtgtggacatttatttattttaaaattgtctgatcaccaccttgagtaaaacacaagcagtcacaattaaaatatattagtgagcaggagaaagcacagcatattatagcactgaatg

SEQ ID NO: 2108 - DNA, 29 bp, Homo sapiens
tcataaaatgtgtcaacggcttttctata

SEQ ID NO: 2109 - DNA, 85 bp, Homo sapiens
gtaaggagactaggttcagatggttaatctaagacaaataaatgagataagccatacacttttacatcctccatgtcctgtcttt

SEQ ID NO: 2110 - DNA, 62 bp, Homo sapiens
gatgttgacaatgcgtctctggcacgtcttgaccttgaacgcaaagtggaatctttgcaaga

SEQ ID NO: 2111 - DNA, 88 bp, Homo sapiens
caggaacagcatgtccaaatcgatgtggatgtttccaagcctgacctcacggctgccctgcgtgacgtacgtcagcaatatgaaagtg

SEQ ID NO: 2112 - DNA, 76 bp, Homo sapiens
ctctgaggctgccaaccggaacaatgacgccctgcgccaggcaaagcaggagtccactgagtaccggagacaggtg

SEQ ID NO: 2113 - DNA, 136 bp, Homo sapiens
gagaactttgccgttgaagctgctaactaccaagacactattggccgcctgcaggatgagattcagaatatgaaggaggaaatggctcgtcaccttcgtgaataccaagacctgctcaatgttaagatggcccttg

SEQ ID NO: 2114 - DNA, 252 bp, Homo sapiens
ctcagacttggatgcgtgaactaatggtgaccatttgttaggccctgtgccactgggctctaagcagtgtcacatttaatctttagaaagtttctttgaggtaactgctttccactttttgtagaggaggaatttgaattgagagagagtaagtgacttgctgaaaaagggttaatcaacagcagagctgggatttgaacccataactctgtcaaagcctccactcctaactcctgttcatgctcctgtgga

SEQ ID NO: 2115 - DNA, 42 bp, Homo sapiens
gatttctctgcctcttccaaacttttcctccctgaacctgag

SEQ ID NO: 2116 - DNA, 288 bp, Homo sapiens
ctttaggaaaaacgtcagctgcttgtaaccactgtgtttatgtcaaagcattcattttttttaggatatctgaaaaaatgccatataagagaaaactctataaaacatctataattttcgaacccaagtacactcttgcattctatgctttaagttaaatgcaaactcctttttccttcttcctgctgcaagtactatctcatcctgatgctcaagagtgtcagggcctgggtttccaaacagagactaccctaaaattatttggcgagtagtactttacacaattgc

SEQ ID NO: 2117 - DNA, 26 bp, Homo sapiens
ctcagcatcacgatgaccttgaataa

SEQ ID NO: 2118 - DNA, 28 bp, Homo sapiens
cactcagtgcagcaatatattaccagca

SEQ ID NO: 2119 - DNA, 38 bp, Homo sapiens
gcagtttttcaggagcgcaagatagatttggaatagga

SEQ ID NO: 2120 - DNA, 41 bp, Homo sapiens
tctagttcttaacaaccgacactcctacaagatttagaaaa

SEQ ID NO: 2121 - DNA, 25 bp, Homo sapiens
gtattttgaataccattaaaactgc

SEQ ID NO: 2122 - DNA, 126 bp, Homo sapiens
agctgcggcggatacccttgcgtgctgtggagaccctactctcttcgctgagaacggccgctagcggggactgaaggccgggagcccactcccgacccggggctagcgtgcgtccctagagtcgag

SEQ ID NO: 2123 - DNA, 43 bp, Homo sapiens
atggatcgccactccagctacatcttcatctggctgcagctgg

SEQ ID NO: 2124 - DNA, 95 bp, Homo sapiens
ttcgatgctactgtgatgctgcccactgtgtagccactggttatatgtgtaaatctgagctcagcgcctgcttctctagacttcttgatcctcag

SEQ ID NO: 2125 - DNA, 140 bp, Homo sapiens
tgcctggactctcttgcaagcacgacagacatctgccaagccaaacaggcccgaaaccactctggcaccaccatacccacattggaatgctgtcatgaagacatgtgcaattacagagggctgcacgatgttctctctcc

SEQ ID NO: 2126 - DNA, 158 bp, Homo sapiens
gcctgcctgatctatagacttgtgacagccacgactttgtatgtctgctattgattttgttgttaatgtaattagagacaccagagggagaagcctggctggatgcaaagatgcatcttgattgagtggcttttatgtctgagcattagatgtctgtc

SEQ ID NO: 2127 - DNA, 104 bp, Homo sapiens
ttgcttattatgttggccctgaggatgcttcgaagtgaaaataagaggctgcaggatcagcggcaacagatgctctcccgtttgcactacagctttcacggaca

SEQ ID NO: 2128 - DNA, 81 bp, Homo sapiens
gcagacctcagcaacgataagatcctctcgcttgttcactggggcatgtacagtgggcacgggaagctggaattcgtatga

SEQ ID NO: 2129 - DNA, 267 bp, Homo sapiens
cggagtcttatctgaactacacttactgaacagcttgaaggccttttgagttctgctggacaggagcactttatctgaagacaaactcatttaatcatctttgagagacaaaatgacctctgcaaacagaatcttggatatttcttctgaaggattatttgcacagacttaaatacagttaaatgtgttatttgcttttaaaattataaaaagcaaagagaagactttgtacacactgtcaccagggttatttgcatccaagggagc

SEQ ID NO: 2130 - DNA, 65 bp, Homo sapiens
ggtcctagagctcgcggtctggtctggtctggtccccagactgacgcctggtcggtccccctctt

SEQ ID NO: 2131 - DNA, 56 bp, Homo sapiens
ggcttctacgctccggcactctgagttcatcagcaaacgccctggcgtctgtcctc

SEQ ID NO: 2132 - DNA, 169 bp, Homo sapiens
ctagcctttgggaccgcttctcgtcgtcgtccacctcctcttcgccctcgtccttgccccgaactcccaccccagatcggccgccgcgctcagcctgggggtcggcgacccgggaggaggggtttgaccgctccacgagcctggagagctcggactgcgagtccctgga

SEQ ID NO: 2133 - DNA, 358 bp, Homo sapiens
ttgcccgacttcgagctgctcagtgaccctgaggatgaacacttgtgtgccaacctgatgcagctgctgcaggagagcctggcccaggcgcggctgggctctcgacgccctgcgcgcctgctgatgcctagccagttggtaagccaggtgggcaaagaactactgcgcctggcctacagcgagccgtgcggcctgcggggggcgctgctggacgtctgcgtggagcagggcaagagctgccacagcgtgggccagctggcactcgaccccagcctggtgcccaccttccagctgaccctcgtgctgcgcctggactcacgactctggcccaagatccaggggctgtttagctccgcca

SEQ ID NO: 2134 - DNA, 510 bp, Homo sapiens
cagagacgactgaacttttggggtggagactagaggcaggagctgagggactgattcctgtggttggaaaactgaggcagccacctaaggtggaggtgggggaatagtgtttcccaggaagctcattgagttgtgtgcgggtggctgtgcattggggacacatacccctcagtactgtagcatgaaacaaaggcttaggggccaacaaggcttccagctggatgtgtgtgtagcatgtaccttattatttttgttactgacagttaacagtggtgtgacatccagagagcagctgggctgctcccgccccagcccggcccagggtgaaggaagaggcacgtgctcctcagagcagccggagggaggggggaggtcggaggtcgtggaggtggtttgtgtatcttactggtctgaagggaccaagtgtgtttgttgtttgttttgtatcttgtttttctgatcggagcatcactactgacctgttgtaggcagctatcttacagacgcatg

SEQ ID NO: 2135 - DNA, 66 bp, Homo sapiens
cacttgaaaaattacacctggcagctgcgtttaagccttcccccatcgtgtactgcagagttgagc

SEQ ID NO: 2136 - DNA, 72 bp, Homo sapiens
cctccccgggaggagtgccatctgggtcttccatctagaactgtttacatgaagataagatactcactgttc

SEQ ID NO: 2137 - DNA, 30 bp, Homo sapiens
ttcaagtattaagacctatgcaatattttt

SEQ ID NO: 2138 - DNA, 32 bp, Homo sapiens
ccgcagctcgcagggagatccagctccgtcct

SEQ ID NO: 2139 - DNA, 72 bp, Homo sapiens
gaagggcttctccatcgccaaggagggcgtggtgggtgcggtggaaaagaccaagcagggggtgacggaagc

SEQ ID NO: 2140 - DNA, 224 bp, Homo sapiens
ggtctagccagtgtccctacctcaggcctgctctctcttgtcccccacattctgtcctgtccccttcccatccatccacttcttccagacacagcaggaagaggccctctgaaggggccgccggcccccagacaccatccttacccccccaccgaccccacagtttgtccagctgttctgttgtgtttgtcctgaccgcccccaacacctcgagggaggtctgg

SEQ ID NO: 2141 - DNA, 28 bp, Homo sapiens
gggctggggtggaggccagccagtgtcc

SEQ ID NO: 2142 - DNA, 106 bp, Homo sapiens
aggagcaggccaacgccgtgagcgaggctgtggtgagcagcgtcaacactgtggccaccaagaccgtggaggaggcggagaacatcgcggtcacctccggggtggt

SEQ ID NO: 2143 - DNA, 31 bp, Homo sapiens
gacttgaggccatctgccccccaacaggagg

SEQ ID NO: 2144 - DNA, 38 bp, Homo sapiens
gtgaggcatccaaagagaaagaggaagtggcagaggag

SEQ ID NO: 2145 - DNA, 89 bp, Homo sapiens
ggctacaggccagcgtggatgacctgaagagcgctcctctgccttggacaccatcccctcctagcacaaggagtgcccgccttgagtga

SEQ ID NO: 2146 - DNA, 97 bp, Homo sapiens
cctcgtctccctggccacccttggcctgtccacctgtgctgctgcaccaacctcactgccctccctcggccccacccaccctctggtccttctgacc

SEQ ID NO: 2147 - DNA, 26 bp, Homo sapiens
cgcacgtccggccccgatcccggcac

SEQ ID NO: 2148 - DNA, 34 bp, Homo sapiens
atgagcttcggctcggagcactacctgtgctcct

SEQ ID NO: 2149 - DNA, 25 bp, Homo sapiens
ccgcctctctggggccggcggcgcg

SEQ ID NO: 2150 - DNA, 704 bp, Homo sapiens
ggcgcgcaccaacgagtacaagatcatccgcaccaacgagaaggagcagctgcagggcctcaacgaccgcttcgccgtgttcatcgagaaggtgcatcagctggagacgcagaaccgcgcgttggaggccgagctggccgcgctgcgacagcgccacgctgagccgtcgcgcgtcggcgagctcttccagcgcgagctgcgcgacctgcgcgcgcagctggaggaggccagctcggctcgctcgcaggccctgctggagcgcgacgggctggcggaggaggtgcagcggctgcgggcgcgctgcgaggaggagagccgcggacgcgaaggcgccgagcgcgccctgaaggcgcagcagcgcgacgtggacggcgccacgctggcccgcctggacctggagaagaaggtggagtcgctgctggacgagctggccttcgtacgccaggtgcacgacgaggaggtagccgagctgctggccacgctgcaggcgtcgtcgcaggccgcggccgaggtggacgtgactgtggctaaaccagacctgacctcggctctgagggagatccgcgcccagtatgagtccctggccgctaagaacctgcagtccgcggaagaatggtacaagtccaagtttgccaacctgaacgagcaggcggcgcgcagcaccgaggccatccgggccagccgcgaggagatccacgagtatc

SEQ ID NO: 2151 - DNA, 41 bp, Homo sapiens
caccaagagtgagatggcacgccaccttcgggaataccagg

SEQ ID NO: 2152 - DNA, 102 bp, Homo sapiens
gacacgttttagcaccagtgggttaagcatttcggggctgaatccacttcccaatccaagttacctgctcccacctagaatcctcagtgctacaacctccaa

SEQ ID NO: 2153 - DNA, 33 bp, Homo sapiens
atccactgggctatcacttaagaaagaggagga

SEQ ID NO: 2154 - DNA, 95 bp, Homo sapiens
gtagcctctaagaaaacctcccagataggggaaagttttgaagaaatattagaggagacagtaatatctactaagaaaaccgagaaatcaaatat

SEQ ID NO: 2155 - DNA, 668 bp, Homo sapiens
agctcacgcttcacagtgatcgatgattcaggtgcagaggaagtacaaactaaggtgctaaatctgcgatcatcgtcatttgctgtgaactgaaattaaaactattcatgctacccagccattacccagctaaataatcttactctagatacctaaaacataagatcactgccagagataaactaatggtccacacccaattccactctgatagaattatttcacaaataataggtgtttgtttaatggacacttttcacctccttcaattccatatatccttttcttctatgtaggaaaaaaatagtctagtgtagtattcttcccttttaaacacattttggttcttctcaaaagaacttacccccattcgcgctctgctcagtgggtaaaattagatgcatgttgaccatgtctatgattcgtgtaattacttatccctgcccatttcatattctttcaattctgtaggttaaaaaaatggcagtgatgaattttaagggtttcccccaacatataaaataatgcaaagaatccctagactttaggctttcagcttacacaaatctatttaattaggaaaaaaactattaaggatgtagcttttcacctttactttagaagcacagtaaatatcccaaactgtgatgaagccgaccttagattta

SEQ ID NO: 2156 - DNA, 245 bp, Homo sapiens
atgccttttacgagtgctaagtgtaggatattttgtcaccagaacacaatgctaccgccccaaagtaaaagaaaccacttctggtcaatcaacactaccagcgtatatataagaaagacatctttctcttttctaaaagacttccctaacacttaccccatggctgcacagttggtggggtcctgccggagaggaagagacactcagaccagagaaggggtgtgcatgcgcctactcgcttgcta

SEQ ID NO: 2157 - DNA, 108 bp, Homo sapiens
gcccaactgtgtagcatctgcattgcccagtctttcatgtgtgccaaggctgatgcaggatttgttctctgtccagcagtcacttcggccagagctgaagagttgccc

SEQ ID NO: 2158 - DNA, 34 bp, Homo sapiens
acaagtgtttgaacaggtaacttctacctttgaa

SEQ ID NO: 2159 - DNA, 38 bp, Homo sapiens
attcaaaggttccaggggagtgtgttggccactctcag

SEQ ID NO: 2160 - DNA, 81 bp, Homo sapiens
acagtacacagtagcttcgggtgtgtcccagtcagtcctaggagctgtggaaagagtagaagtgcctgaatgtggtgctga

SEQ ID NO: 2161 - DNA, 111 bp, Homo sapiens
cagaggatggaatgccacaggccccacttcgtctcccagcccttcatctttcttccatgtccaaaggcggctccccagaggccaagggctcagctcttgtgttctctgaga

SEQ ID NO: 2162 - DNA, 92 bp, Homo sapiens
agcttttaagaactgctctgtagaaagaacaaaccctaatctagctccagcaaagagccaggatcatgctgaacttcctgtgagccttcgtg

SEQ ID NO: 2163 - DNA, 101 bp, Homo sapiens
ccaggaagtgaagtccccgagcacgttagaaagcctgacatggcctgactcgggacagctcagagcagggcagaactggggacactctgggccggccttct

SEQ ID NO: 2164 - DNA, 130 bp, Homo sapiens
atggacgctctgaagccaccctgtctctggaggaaccacgagcgagggaagaaggacagggactcgtgtggcaggaagaactcagagccgggaagcccccattcactagaagcactgagagatgcggccc

SEQ ID NO: 2165 - DNA, 29 bp, Homo sapiens
gtctgaatttcctgctgctgttcacaaag

SEQ ID NO: 2166 - DNA, 110 bp, Homo sapiens
cggcgttgatctgcatcctgacatttggagctgccatcttcttgtggctgatcaccagacctcaacccgtcttacctcttcttgacctgaacaatcagtctgtgggaatt

SEQ ID NO: 2167 - DNA, 49 bp, Homo sapiens
caatgggccctgcttgggatatagaaaaccaaaccagccctacagatgg

SEQ ID NO: 2168 - DNA, 83 bp, Homo sapiens
gtgtctgatagagcagagtacctgggttcctgtctcttgcataaaggttataaatcatcaccagaccagtttgtcggcatctt

SEQ ID NO: 2169 - DNA, 87 bp, Homo sapiens
ggatcatctccgaattggcttgttacacgtactctatggtagctgtacctctgtatgacaccttgggaccagaagccatcgtacata

SEQ ID NO: 2170 - DNA, 27 bp, Homo sapiens
catggtgatctgtgacacaccccaaaa

SEQ ID NO: 2171 - DNA, 46 bp, Homo sapiens
ctcctagcccagaagacctgagcgtcatctgcttcaccagtgggac

SEQ ID NO: 2172 - DNA, 27 bp, Homo sapiens
gctacctattagctacataaagtatct

SEQ ID NO: 2173 - DNA, 28 bp, Homo sapiens
ccaaaggagccatgataacccatcaaaa

SEQ ID NO: 2174 - DNA, 109 bp, Homo sapiens
tgtggagccagagttggattcttccaaggggatattcggttgctggctgacgacatgaagactttgaagcccacattgtttcccgcggtgcctcgactccttaacagga

SEQ ID NO: 2175 - DNA, 44 bp, Homo sapiens
agggtatcatcaggcatgatagtttctgggacaagctcatcttt

SEQ ID NO: 2176 - DNA, 75 bp, Homo sapiens
ggcggaagggttcgtgtaattgtcactggagctgcccccatgtccacttcagtcatgacattcttccgggcagca

SEQ ID NO: 2177 - DNA, 71 bp, Homo sapiens
tcacgttggggtgcccctggcttgcaattacgtgaagctggaagatgtggctgacatgaactactttacag

SEQ ID NO: 2178 - DNA, 120 bp, Homo sapiens
tgaagatcatcgaccgtaaaaagaacattttcaagctggcccaaggagaatacattgcaccagagaagatagaaaatatctacaacaggagtcaaccagtgttacaaatttttgtacacg

SEQ ID NO: 2179 - DNA, 81 bp, Homo sapiens
ggttcctgacacagatgtacttccctcatttgcagccaagcttggggtgaagggctcctttgaggaactgtgccaaaacca

SEQ ID NO: 2180 - DNA, 34 bp, Homo sapiens
tgtaagggaagccattttagaagacttgcagaaa

SEQ ID NO: 2181 - DNA, 118 bp, Homo sapiens
ttcatccagagccattttccattgaaaatgggctcttgacaccaacattgaaagcaaagcgaggagagctttccaaatactttcggacccaaattgacagcctgtatgagcacatcca

SEQ ID NO: 2182 - DNA, 41 bp, Homo sapiens
agtacctgccggcccactgtgcactgcttgtgagaaaatgg

SEQ ID NO: 2183 - DNA, 65 bp, Homo sapiens
aacctgttaaactctaaagccatagcttttgttttatattgagacatataatgtgtaaacttagt

SEQ ID NO: 2184 - DNA, 530 bp, Homo sapiens
ttcagggctacttttatcaacatgcctgtcttcaagatcccagtttatgttctgtgtccttcctcatgatttccaaccttaatactattagtaaccacaagttcaagggtcaaagggaccctctgtgccttcttctttgttttgtgataaacataacttgccaacagtctctatgcttatttacatcttctactgttcaaactaagagatttttaaattctgaaaaactgcttacaattcatgttttctagccactccacaaaccactaaaattttagttttagcctatcactcatgtcaatcatatctatgagacaaatgtctccgatgctcttctgcgtaaattaaattgtgtactgaagggaaaagtttgatcataccaaacatttcctaaactctctagttagatatctgacttgggagtattaaaaattgggtctatgacatattgtccaaaaggaatgctgttcttaaagcattatttacagtaggaactggggagtaaatctgttccctacagtttgctgctg

SEQ ID NO: 2185 - DNA, 82 bp, Homo sapiens
ctgtgaaggaaccaactgatctcccccacccttggattagagttcctgctctaccttacccacagataacacatgttgtttc

SEQ ID NO: 2186 - DNA, 184 bp, Homo sapiens
agctccccctgtcaaagcaccttggcccataagaagaaaagggggagccccagatgtgatgagcgcttccaggcttcaggctcagaaggcgcccccagctctcctgtaactcagaggccagtgtgatgggagttcctccactcagcacacttcccctgtaaacacgcctgtggtgggcaaaagg

SEQ ID NO: 2187 - DNA, 27 bp, Homo sapiens
tttctctcctgcgtaatttccactttc

SEQ ID NO: 2188 - DNA, 107 bp, Homo sapiens
tcactggctcaaccaaccggtggcgtttgcccaaacagcctttctctggggacctgctctcactttcccagatgtgcaaggctctgagcatagactttgaggaagct

SEQ ID NO: 2189 - DNA, 26 bp, Homo sapiens
acaaggacatccaaagtggggaagca

SEQ ID NO: 2190 - DNA, 100 bp, Homo sapiens
atgtgattctcgagtgcctgggcttcaaatgggagctccatcagccccagctttttcagtctgagaccttggccaagctctacctgaaagccctggcgca

SEQ ID NO: 2191 - DNA, 88 bp, Homo sapiens
cacggccctgaagaacctctacatgagtgaggtggagattaacttggaagacctactgggagtgctggcttccgcccacatcctccag

SEQ ID NO: 2192 - DNA, 110 bp, Homo sapiens
agcagctcaccaccggctgcgagaagtggctggaaatgaacttggttcctctaggggggacgcagatccacctccacaaaatcccacaggacctgctccacaaagtgctg

SEQ ID NO: 2193 - DNA, 75 bp, Homo sapiens
gcttttgtgggtcttcttgcaactgaactacaagattcaggcaattccgacttatgaaaccgtgatgacattttt

SEQ ID NO: 2194 - DNA, 38 bp, Homo sapiens
ctttcctgagaactgttgctttctggaccgggacatag

SEQ ID NO: 2195 - DNA, 31 bp, Homo sapiens
tcttcctctgcttgcgtctgcacggcatcac

SEQ ID NO: 2196 - DNA, 38 bp, Homo sapiens
ggggcgacatggtccacctgaaagatcttaacacccag

SEQ ID NO: 2197 - DNA, 86 bp, Homo sapiens
gagaatacaacttattcgaaaacgattgctctatatggattcttctttaagataaagggactcaaacatgatactacctcttatag

SEQ ID NO: 2198 - DNA, 57 bp, Homo sapiens
ggaatctccctctgcggtctacgagcacaaccacgtcagcctgcgagcggcacgcct

SEQ ID NO: 2199 - DNA, 28 bp, Homo sapiens
gcagaggccctggttgacggcaagtggc

SEQ ID NO: 2200 - DNA, 45 bp, Homo sapiens
aaaatccaaactgtgggcatcccaatctatgtaagttttgcattc

SEQ ID NO: 2201 - DNA, 52 bp, Homo sapiens
ccagaagaatctatgggattttccccccactggtctgcataaaagaaaataa

SEQ ID NO: 2202 - DNA, 65 bp, Homo sapiens
tctctcctgcttggcgacttcagtaagctacagctaagcccatcggccggaaaagaaagacaata

SEQ ID NO: 2203 - DNA, 26 bp, Homo sapiens
tgaggtctgccagaaggccctgcgtg

SEQ ID NO: 2204 - DNA, 26 bp, Homo sapiens
ttgctggcccccctaattatccattt

SEQ ID NO: 2205 - DNA, 135 bp, Homo sapiens; identical to SEQ ID NO: 2072

SEQ ID NO: 2206 - DNA, 25 bp, Homo sapiens
ggttgcctatagtgctctgggatcc

SEQ ID NO: 2207 - DNA, 25 bp, Homo sapiens
ccaacttcaaccacaggctgctgga

SEQ ID NO: 2208 - DNA, 73 bp, Homo sapiens
gtgaggaagtgatcccaaaagatgaaaatggaaaaatactatttgacacagtggatctctgtgccacatggga

SEQ ID NO: 2209 - DNA, 25 bp, Homo sapiens
ggagcgctgcatcacctacctcatg

SEQ ID NO: 2210 - DNA, 47 bp, Homo sapiens
gcaattcccatcgaccagagttggtccgaccagccttggaaaggtca

SEQ ID NO: 2211 - DNA, 26 bp, Homo sapiens
gagagaagacatattctacacttcaa

SEQ ID NO: 2212 - DNA, 47 bp, Homo sapiens
aaagtaaagctctagaggccgtcaaattggcaatagaagccgggttc

SEQ ID NO: 2213 - DNA, 66 bp, Homo sapiens
cagtgtgtgaagctgaatgatggtcacttcatgcctgtcctgggatttggcacctatgcgcctgca

SEQ ID NO: 2214 - DNA, 36 bp, Homo sapiens
ggaggaagaaacatttgctaaccaggccagtgacag

SEQ ID NO: 2215 - DNA, 81 bp, Homo sapiens
gtaagaaacggttgaactggatgcaatttttatcacagcttgtgtaagactgcctctgtccctcctctcacatgccattgg

SEQ ID NO: 2216 - DNA, 27 bp, Homo sapiens
tgtgctatccctatgtgtattgattat

SEQ ID NO: 2217 - DNA, 26 bp, Homo sapiens
tgcgatggtgcaatcccaactcactg

SEQ ID NO: 2218 - DNA, 43 bp, Homo sapiens
accattggaatgacatactgcatcctatagttataccatccac

SEQ ID NO: 2219 - DNA, 141 bp, Homo sapiens
agccctagccaacgccgcatgagagggagtgtgccgagggcttctgagaaggtttctctcacatctagaaagaagcgcttaagatgtggcagcccctcttcttcaagtggctcttgtcctgttgccctgggagttctcaaa

SEQ ID NO: 2220 - DNA, 31 bp, Homo sapiens
tgccagccaagtgaagacatgcttacttccc

SEQ ID NO: 2221 - DNA, 56 bp, Homo sapiens; identical to SEQ ID NO: 2073

SEQ ID NO: 2222 - DNA, 806 bp, Homo sapiens
gtggggcaggacatcgaagatatcattgactcatcacattcccctgaatagctcatatttagaaaatattcttagattgtaaaaatgtactgttcatttgttatatgcaatcttttaaatgttttatactttaaacaaggcatagttacaagtataaaacataaatatcccaaagccattatgcatggcactcaagattaaaatgggaaataatacatctaataaatcaaatgttccaagacttcaaatgtcttttggaaacaggctatgtaaaacagcacactggtttcaaactttggtaaattttaagaagaactcttacaaaggcatttaattcttatacataattttcaggggaactaatcaaatcagctaatcatgaagacatgattttcgttttagaaaacacttttgaaaacttgggataatctcatgtcttaatgatcaaagcattatgagaaggacagtggttttttacctgggcacactttctaacacatttactctccactattcgtactctggtagccatgttaaccccatcagagattccttctcaagccatgtctcagagctgataggcatcccagcaagttttgcagctcacaatttttctgtaaattacttattctataaaattggaagaggccataaactttggagggccctagaccaattttttggattatttctggtctactctcattccgttgatgatcttagatattctctgcattaaatatcacctctaggctgagaaatccaccaaaaaatatttctagctcagcgttttcctccaaatcttc

SEQ ID NO: 2223 - DNA, 25 bp, Homo sapiens
ttgttcagtatgttgtgctttaatt

SEQ ID NO: 2224 - DNA, 25 bp, Homo sapiens
tgcaggtttaaccaggtccatcagg

SEQ ID NO: 2225 - DNA, 86 bp, Homo sapiens
actctcttggaggtaatagctgcaagaactctcccaacagggacttctgtgcaaaaggctgagtaaattgcccttatgagagcctt

SEQ ID NO: 2226 - DNA, 46 bp, Homo sapiens
aaagccattgacagcctcaacggaaatctccgacatgctaagttac

SEQ ID NO: 2227 - DNA, 41 bp, Homo sapiens
ggctgtggtcctggtcaagagctccaatgaacagcagatca

SEQ ID NO: 2228 - DNA, 26 bp, Homo sapiens
acagtgctctgggaacccaacgacat

SEQ ID NO: 2229 - DNA, 30 bp, Homo sapiens
gattctgctcatttatacaataatgaggag

SEQ ID NO: 2230 - DNA, 47 bp, Homo sapiens
tccaaatcattcctagccaaagctctgactcgttacctatgtgtttt

SEQ ID NO: 2231 - DNA, 36 bp, Homo sapiens
tcagcaaacaggaatacgatgaagccgggccttcca

SEQ ID NO: 2232 - DNA, 102 bp, Homo sapiens
ggcatccatgaaaccacctacaacagcatcatgaagtgtgatattgacatcaggaaggacctctatgctaacaatgtcctatcagggggcaccactatgtac

SEQ ID NO: 2233 - DNA, 84 bp, Homo sapiens
tcatcctcccttgagaagagttacgagttgcctgatgggcaagtgatcaccatcggaaatgaacgtttccgctgcccagagacc

SEQ ID NO: 2234 - DNA, 73 bp, Homo sapiens
ctggctggccgagatctcactgactacctcatgaagatcctgactgagcgtggctattccttcgttactactg

SEQ ID NO: 2235 - DNA, 54 bp, Homo sapiens
atgtatgtggctatccaggcggtgctgtctctctatgcctctggacgcacaact

SEQ ID NO: 2236 - DNA, 68 bp, Homo sapiens
ctctttctacaatgagcttcgtgttgcccctgaagagcatcccaccctgctcacggaggcacccctga

SEQ ID NO: 2237 - DNA, 93 bp, Homo sapiens
caggatgcataatccctgtgttctctgatacagaacaccacactactgctggggaaataactggctcacattgctcaactgtacttttacttg

SEQ ID NO: 2238 - DNA, 76 bp, Homo sapiens
acagctacgtgggtgacgaagcacagagcaaaagaggaatcctgaccctgaagtacccgatagaacatggcatcat

SEQ ID NO: 2239 - DNA, 81 bp, Homo sapiens
tgggctctgtaaggccggctttgctggggacgatgctcccagggctgttttcccatccattgtgggacgtcccagacatca

SEQ ID NO: 2240 - DNA, 32 bp, Homo sapiens
gaaccacattgtgcaaaccttctctcctgtca

SEQ ID NO: 2241 - DNA, 27 bp, Homo sapiens
agcaggaagtggctatgctgggggtgc

SEQ ID NO: 2242 - DNA, 37 bp, Homo sapiens
tgggccctgattttgggcatcttcatgaccattctgc

SEQ ID NO: 2243 - DNA, 25 bp, Homo sapiens
gttggtcgtccaggcccagcgatag

SEQ ID NO: 2244 - DNA, 94 bp, Homo sapiens
cgtgacctgtatcccacgtactctatcttccattcctcgccctgcccccagaggccaggagctctgcccttgacctgtattccacttactccac

SEQ ID NO: 2245 - DNA, 33 bp, Homo sapiens
gagtcctgcatcagccctttatcctcacacgct

SEQ ID NO: 2246 - DNA, 97 bp, Homo sapiens
ttggggcaggaaactttggccaccaggcctctgacctgcaccaggagacactgggaggtttagtccccaaacccgcacagagcaggactgcagcctg

SEQ ID NO: 2247 - DNA, 43 bp, Homo sapiens
ttaaaccacacctcattggtccctggctaattcaccaatttac

SEQ ID NO: 2248 - DNA, 94 bp, Homo sapiens
gtctcactgagcaccgtcccagcatccggacaccacagcggcccttcgctccacgcagaaaaccacacttctcaaaccttcactcaacacttcc

SEQ ID NO: 2249 - DNA, 116 bp, Homo sapiens
atccttccaaggtccaccgtgatcaacatccacagcgagacctccgtgcccgaccatgtcgtctggtccctgttcaacaccctcttcttgaactggtgctgtctgggcttcatagc

SEQ ID NO: 2250 - DNA, 33 bp, Homo sapiens
atcctcatgaccattggattcatcctgttactg

SEQ ID NO: 2251 - DNA, 38 bp, Homo sapiens
gtattcggctctgtgacagtctaccatattatgttaca

SEQ ID NO: 2252 - DNA, 41 bp, Homo sapiens
tagccgcccatagcctgcaacctttgcactccactgtgcaa

SEQ ID NO: 2253 - DNA, 65 bp, Homo sapiens
ttggtcctgcccctagatacagcagtttatacccacacacctgtctacagtgtcattcaataaag

SEQ ID NO: 2254 - DNA, 26 bp, Homo sapiens
taaatagcagccaccgctccctggca

SEQ ID NO: 2255 - DNA, 30 bp, Homo sapiens
gagaatatccagagattctttggccatggt

SEQ ID NO: 2256 - DNA, 73 bp, Homo sapiens
atctggctgtgaggccctcagggcagggatacaaagcggggagagggtacacaatgggtatctaataaatact

SEQ ID NO: 2257 - DNA, 109 bp, Homo sapiens
ggctcagacttgataacacccgtggtgccccatccctataggagctggtgagattgcagcctgctgcctcccctccaacagccacagctattggatttcccacccagaa

SEQ ID NO: 2258 - DNA, 54 bp, Homo sapiens
gtgctgccaccagcttggattttcattgtttgaaattgcactttaaatacttta

SEQ ID NO: 2259 - DNA, 59 bp, Homo sapiens
gaaggaggtggtgtaatgaatctcaaccccggcaacaacctccttcaccagccgccagc

SEQ ID NO: 2260 - DNA, 82 bp, Homo sapiens
accaaccagctggatgccaattgtatccctttccaagagttcgacatcaacggcgagcacctctgcagcatgagtttgcagg

SEQ ID NO: 2261 - DNA, 62 bp, Homo sapiens
gccagtgcagtagtgacctgttccagtccacacacaatgtcattgtcaagactgaacaaact

SEQ ID NO: 2262 - DNA, 43 bp, Homo sapiens
tggacagcaaaactttctgccgggctcagatctccatgacaac

SEQ ID NO: 2263 - DNA, 25 bp, Homo sapiens
tgaaaaaggagcaagacccccctgc

SEQ ID NO: 2264 - DNA, 177 bp, Homo sapiens
cgagagggactcacttatgggaattcatccgcgacatcctcttgaacccagacaagaacccaggattaataaaatgggaagaccgatctgagggcgtcttcaggttcttgaaatcagaggcagtggctcagctatggggtaaaaagaagaacaacagcagcatgacctatgaaaagc

SEQ ID NO: 2265 - DNA, 40 bp, Homo sapiens
attctggagcgtgtggatggacgaagactggtatataaat

SEQ ID NO: 2266 - DNA, 63 bp, Homo sapiens
caaagaactcctggacgtaaatatttcaaagactacttttctctgatatttatgtaccatgag

SEQ ID NO: 2267 - DNA, 1215 bp, Homo sapiens
caaggttggctataatctctgcataaccacatgacttggaatgcttaaatcagcaagaagaataatggtggggtctttatactcattcaggaatggtttatctgatgccagggctgtcttcctttctcccctttggatggttggtgaaatactttaattgccctgtctgctcacttctagctatttaagagagaacccagcttggttcttttttgctccaagtgcttaaaaataagttggaaaaaggagacggtggtgtggaaatggctgaagagtttgctcttgtatccctatagtccaaggtttctcaatctgcacaattgacatttttggccggagtgttctttgtggtgagggctttcctgtgcattgtaagatgttcagcagtatccactcatggtctctaaccacttgacaccagaaaccccccagctgtgataacgcaaaatgtctctagacatcaccaaatgttccctgggggtggcaaatttgcccttgattgagaaccaccagtttagctagtcaatatgaggatggtggtttattctcagaagaaaaagatatgtaaggtcttttagctccttagagtgaagcaaaagcaagacttcaacctcaacctatctttatgttttaaatgttagggacaataagttgaaatagctagaggagcttcttttcagaaccccagatgagagccaatgtcagataaagtaagcatagtaatgtagcaggaactacaatagaagacattttcactggaattacaaagcagaattaaaattatattgtagaaggaaacaccaagaaaagaatttccagggaaaatcctctttgcaggtattaattcttataattttttgtcttttggattatctgtttactgtctcatctgaactgatcccaggtgaacggtttattgcctagatttgtactcagaggaattttttttgttttgttttgtcttttaagaaaggaaagaaaggatgaaaaaaataaacagaaaactcagctcaggcacaattgtcaccaaggagttaaaagcttcttcttcaatagaggaattgttctgggggtcctggagacttaccattgagccatgcaatctgggaagcacaggaataagtagacactttgaaaatggatttgaatgttctcatcccttttgcagcttttctttttggctctctcatgtccttggcttgctcctctattcta

SEQ ID NO: 2268 - DNA, 60 bp, Homo sapiens
catgtatccataagaaggagtgctcttcatcaactaatagagcacctaccacagtgtcat

SEQ ID NO: 2269 - DNA, 163 bp, Homo sapiens
cccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttca

SEQ ID NO: 2270 - DNA, 64 bp, Homo sapiens
tggacaagttttggtggcacgcagcctggggactctgcctcgtgccgctgagcctggcgcagat

SEQ ID NO: 2271 - DNA, 27 bp, Homo sapiens
atttgaatataacctgccgctttgcag

SEQ ID NO: 2272 - DNA, 116 bp, Homo sapiens
aatggtcgctacagcatctctcggacggaggccgctgacctctgcaaggctttcaatagcaccttgcccacaatggcccagatggagaaagctctgagcatcggatttgagacctg

SEQ ID NO: 2273 - DNA, 257 bp, Homo sapiens
gtaagagaccagcacccgaccactggggaaagctggcggcctgggaccaggcagctgggcttagaactggaaggctcctttcccacagctgaatggattattgcctaaggagtcaaccccacgtattaatttggccaagtcaatctgcaacctgtatgacaactggagtttaaagtcagctaaagacacctttgtgaatcatagagcgggaacccagaggaagccattaggggtcctctcggctggaatcctcttgt

SEQ ID NO: 2274 - DNA, 108 bp, Homo sapiens
agggcacgtggtgattccccggatccaccccaactccatctgtgcagcaaacaacacaggggtgtacatcctcacatccaacacctcccagtatgacacatattgctt

SEQ ID NO: 2275 - DNA, 93 bp, Homo sapiens
tattgttaaccgtgatggcacccgctatgtccagaaaggagaatacagaacgaatcctgaagacatctaccccagcaaccctactgatgatga

SEQ ID NO: 2276 - DNA, 38 bp, Homo sapiens
cagcggctcctccagtgaaaggagcagcacttcaggag

SEQ ID NO: 2277 - DNA, 26 bp, Homo sapiens
cttttctactgtacaccccatcccag

SEQ ID NO: 2278 - DNA, 38 bp, Homo sapiens
acagtccctggatcaccgacagcacagacagaatccct

SEQ ID NO: 2279 - DNA, 30 bp, Homo sapiens
gtaaggagaataaatcactgtgcttcccaa

SEQ ID NO: 2280 - DNA, 68 bp, Homo sapiens
ttccctggcaaaatgtctctgaccttcctgagcattgcacactcacgtgctgattttctcgtctctag

SEQ ID NO: 2281 - DNA, 32 bp, Homo sapiens
acagctggaagctggtgatgccattcagggag

SEQ ID NO: 2282 - DNA, 38 bp, Homo sapiens
gcgtccagctcagccactaatgcaagtcaccacaacag

SEQ ID NO: 2283 - DNA, 56 bp, Homo sapiens
cctcagtttttctggatcaggcattgatgatgatgaagattttatctccagcacca

SEQ ID NO: 2284 - DNA, 77 bp, Homo sapiens
aatggcaccactgcttatgaaggaaactggaacccagaagcacaccctcccctcattcaccatgagcatcatgagga

SEQ ID NO: 2285 - DNA, 121 bp, Homo sapiens
ccaggcaactcctagtagtacaacggaagaaacagctacccagaaggaacagtggtttggcaacagatggcatgagggatatcgccaaacacccaaagaagactcccattcgacaacaggg

SEQ ID NO: 2286 - DNA, 134 bp, Homo sapiens
cactggaggaattgtcacgagatgttaggttacttaataaattatgctgcagttcacacagagccaaaccttaaaggctcataacaagtcacctgaacaggaatggatacaagccagttatgaataagaacagg

SEQ ID NO: 2287 - DNA, 160 bp, Homo sapiens
ggtaactcatcctttctgcactgcgggagttgttaatgcttttgtgtcctccagttcacatgctgattgctaagaagaaaatgagcatgagtgaacccaaagctgctgaaacattctgcgtttatgcaacttccttgccctctatacaaggaagatggtt

SEQ ID NO: 2288 - DNA, 58 bp, Homo sapiens
tcggtgtatccctgaccaagcgtccattaacactttgacaattgctcaaactgcatgg

SEQ ID NO: 2289 - DNA, 107 bp, Homo sapiens
gctcataccagccatccaatgcaaggaaggacaacaccaagcccagaggacagttcctggactgatttcttcaacccaatctcacaccccatgggacgaggtcatca

SEQ ID NO: 2290 - DNA, 66 bp, Homo sapiens
gactccagtcatagtataacgcttcagcctactgcaaatccaaacacaggtttggtggaagatttg

SEQ ID NO: 2291 - DNA, 70 bp, Homo sapiens
cttctctacatcacatgaaggcttggaagaagataaagaccatccaacaacttctactctgacatcaagc

SEQ ID NO: 2292 - DNA, 116 bp, Homo sapiens
ctgaaggctcaactactttactggaaggttatacctctcattacccacacacgaaggaaagcaggaccttcatcccagtgacctcagctaagactgggtcctttggagttactgca

SEQ ID NO: 2293 - DNA, 150 bp, Homo sapiens
cccattcaaggctgttttgccatcattttttggaataccttaaaaagactaaactttgtgataggctgtataagaatgcaaaggtaaagaaatgcagatgggagtgtaagtgaaaacatgcagtactgaccttcctgattgctcattaca

SEQ ID NO: 2294 - DNA, 33 bp, Homo sapiens
ccagtggggggtcccataccactcatggatctg

SEQ ID NO: 2295 - DNA, 39 bp, Homo sapiens
agcaaacacaacctctggtcctataaggacaccccaaat

SEQ ID NO: 2296 - DNA, 28 bp, Homo sapiens
aatggctgatcatcttggcatccctctt

SEQ ID NO: 2297 - DNA, 781 bp, Homo sapiens
cgtcttcttgctgttaggaggtctatgaagcagagaagaactttcctttggaaaacaactaaatgaagacagtcacctcgctagaactgacacatgggctgtttttatattcttgaaggccactctctccctacctgaaccaagacctataggtttacatgttatttacattttatatataatatatatatatatatatacacatacattatatatacacaatagtaattctagcaacagaggaaatgacctttaacaggggtataaatctaaatttataaaagtataaatctaaatttcttacccaagacactttaaagatacattatttttctccaggacgtaattcataggaatattaagccttttgtaaatgtccctttagatggtttctcataaggtaaaagaaacttatttccaagcaggaccacctttattgtgtccccagatcacctcacagggcagaaaaatgcccctcagtctgggagaagacctagagagaattatggactccttactggtttttggaaagcaaccaacagctaattccaacaccatgggcagcccatacagtctctaattatctgagaaaatcaaatgatgctgttacaataattacgctggtacaagttaataaaagtgccatgttacagtcaaacagctatgttgctatctataccattgagggcatagttttaaaaagtagttatgctacctgattgtataaggaacaaaactgagagaaaaaatctaaaaggccgcctatgattgaatggaaaga

SEQ ID NO: 2298 - DNA, 97 bp, Homo sapiens
ccaagtggactcaacggagaggccagcaagtctcaggaaatggtgcatttggtgaacaaggagtcgtcagaaactccagaccagtttatgacagctg

SEQ ID NO: 2299 - DNA, 42 bp, Homo sapiens
acaaggaacctgcagaatgtggacatgaagattggggtgtaa

SEQ ID NO: 2300 - DNA, 506 bp, Homo sapiens
ccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctg

SEQ ID NO: 2301 - DNA, 1353 bp, Homo sapiens
tttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcaca

SEQ ID NO: 2302 - DNA, 159 bp, Homo sapiens
agacaaagccccttacactccttagttctttattcagcattgttctgctctcatttattaaaaattccaagtaccattgtcagtattcttcagaaaatcttatagtgctgtctcatttctcttggcaaaagaaagcctgttgtgcaacccaatgaattt

SEQ ID NO: 2303 - DNA, 124 bp, Homo sapiens
tctcttcaatatagttacacaggtgactaagtgtcacccgcttccaccttctctaatcaaggaaatggtgacgatcaggttactatagattccttataaggtgccttcataatggataactgta

SEQ ID NO: 2304 - DNA, 199 bp, Homo sapiens
tgggctgcaatgcattatgctgatgggtgtccacaccaagttcagcatcgatatggtgacctcctaggagtgggagaccgccaggttgactaaggaagggtgagctggcccaggtcagaatggaacagattgaaactctggtgctgatcatggtgggattgggcacacaagcctgacaacaccaggacaccctgtctct

SEQ ID NO: 2305 - DNA, 44 bp, Homo sapiens
tccagcctcaggtctcaaggatagaggtgccaccacttcccaat

SEQ ID NO: 2306 - DNA, 30 bp, Homo sapiens
agcctgccagcacctattccacctcccagc

SEQ ID NO: 2307 - DNA, 42 bp, Homo sapiens
ccctgctgcccatccggaccttgcccttgatcctgattctgc

SEQ ID NO: 2308 - DNA, 120 bp, Homo sapiens
ttcaacatctcaagcctctctggtctgctgtccccggcgctaacggagagcctgctggttgccttgcccccctgtcacctcacaggaggcaatgccacactgatggtccggagagccaat

SEQ ID NO: 2309 - DNA, 107 bp, Homo sapiens
tggtgacgtccagctttgtggtgcctccgtgccgtgggcgcagggaactggtgagtgtggtggacagtggtgctggcttcacagtcactcggctcagtgcataccag

SEQ ID NO: 2310 - DNA, 25 bp, Homo sapiens
gtgacaaacctcgtgccaggaacca

SEQ ID NO: 2311 - DNA, 69 bp, Homo sapiens
catttcctacctagtgaagaaggggacagccactgagtccagcagagagatcccaatgtccacactccc

SEQ ID NO: 2312 - DNA, 47 bp, Homo sapiens
gcatggtggtcatcacggtgctgctctctgtcgccatgttcctgctg

SEQ ID NO: 2313 - DNA, 41 bp, Homo sapiens
gtgctgggcttcatcattgccctggcactgggctcccgcaa

SEQ ID NO: 2314 - DNA, 150 bp, Homo sapiens
agtgcctcaccttccaacactccattattcctctcaccccactcctgtcagagttgactttcctcccattttaccactttaaacacccccataacaattcccccatccttcagtgaactaagtccctataataaaggctgaggctgcatc

SEQ ID NO: 2315 - DNA, 25 bp, Homo sapiens
tgcagacggctgcgaggcgctgggc

SEQ ID NO: 2316 - DNA, 30 bp, Homo sapiens
gcagggctgagactatcttctgctcaggaa

SEQ ID NO: 2317 - DNA, 62 bp, Homo sapiens
tctcatgtttttctataagcagttaagagaagccacacagcatcctgaacactttgctttct

SEQ ID NO: 2318 - DNA, 80 bp, Homo sapiens
atggcaaatttcaagggccacgcgcttccagggagtttcttcctgatcattgggctgtgttggtcagtgaagtacccgct

SEQ ID NO: 2319 - DNA, 46 bp, Homo sapiens
gtactttagccacacgcggaagaacagcccactacattactatcag

SEQ ID NO: 2320 - DNA, 49 bp, Homo sapiens
cgtctcgagatcgtcgaagccgcaattaggactttgttttccgtcactg

SEQ ID NO: 2321 - DNA, 192 bp, Homo sapiens
gtcatttggtctagggaatctcctcatcatacccagaacctttaattcattttctgagccctgtgaaatagatgttcccactggcagagataatagggcaacaatttcctgatggccactagactattttatcgtaacatccattgtgtacagagctttataatactaacggttgacagctctcacatcatg

SEQ ID NO: 2322 - DNA, 74 bp, Homo sapiens
caccatgtacctattctttgcagtctcaggaattgttgacatgctcacctatctggtcagccacgttcccttgg

SEQ ID NO: 2323 - DNA, 132 bp, Homo sapiens
aaccggcctccgctggaccagcacatccactcactcctgctgtatgctctgttcggagggtgtgttagtatctccctagaggtgatcttccgggaccacattgtgctggaacttttccgaaccagtctcatc

SEQ ID NO: 2324 - DNA, 139 bp, Homo sapiens
attgggtttgtgctgttcccaccttttggaacacccgaatgggaccagaaggatgatgccaacctcatgttcatcaccatgtgcttctgctggcactacctggctgccctcagcattgtggccgtcaactattctcttg

SEQ ID NO: 2325 - DNA, 102 bp, Homo sapiens
ccttttgactcggatgaagagacacggaaggggagaaatcattggaattcagaagctgaattcagatgacacttaccagaccgccctcttgagtggctcaga

SEQ ID NO: 2326 - DNA, 1032 bp, Homo sapiens
taaagtctgtgttggtatagtacccttcataaggaaaaatgaagtaatgcctataagtagcaggcctttgtgcctcagtgtcaagagaaatcaagagatgctaaaagctttacaatggaagtggcctcatggatgaatccggggtatgagcccaggagaacgtgctgcttttggtaacttatccctttttctcttaagaaagcaggtactttcttattagaaatatgttagaatgtgtaagcaaacgacagtgcctttagaattacaattctaacttacatattttttgaaagtaaaataattcacaagctttggtattttaaaattattgttaaacatatcataactaatcataccagggtactgcaataccactgtttataagtgacaaaattaggccaaaggtgatttttttttaaatcaggaagctggttactggctctactgagagttggagccctgatgttctgattcttcaaagtcaccctaaaagaagatctgacaggaaagctgtataatgagatagaaaaacgtcaggtatggaaggctttcagttttaatatggctgaaagcaaaggataacgaattcagaattagtaatgtaaaatcttgataccctaatcttgcttctggatctgttctttttttaaaaaaacttccttcaccgcgcctataatcctagcactttgggaggccgaggcaggcagatcacggggtcaggagatcaagaccatcctggctaacatggtgaaaccccgtctctactgaaaatacaaaaaattagccgggtgtggtggcgggcgcctgtagttccagctactcgggaggctgaggcaagagaatggcatgaacccggtaggggagcttgcagtgagcccagatcatgccactgtactccagcctaggtgacagagcaagactctgtctcaaaaacaagcaaacagacttccttcaacaaatatttattaaatatccactttgcaacagcactgaaatggctgtaaggactcctgagatatgtgtccagcaagg

SEQ ID NO: 2327 - DNA, 314 bp, Homo sapiens
cgtgccactcaatacaaatgttctgctatagggttggtgggacagagctgtcttccttctgcatgtcagcacagtcgggtattgctgcctcccgtatcagtgactcattagagttcaatttttatagataatacagatattttggtaaattgaacttggtttttctttcccagcatcgtggatgtagactgagaatggctttgagtggcatcagcttctcactgctgtgggcggatgtcttggatagatcacgggctggctgagctggactttggtcagcctaggtgagactcacctgtccttctggggtctta

SEQ ID NO: 2328 - DNA, 119 bp, Homo sapiens
agaaacttatcaaggctctgtttgatgtcctggcccatccccagaactatttcaagtacacagcccaggagtcccgagagatgtttccaagatcgttcatccgattgctacgttccaaa

SEQ ID NO: 2329 - DNA, 69 bp, Homo sapiens
gactaccaggaactcattgaagacatagttcgagatggcaggctctatgcatctgagaaccatcaggaa

SEQ ID NO: 2330 - DNA, 48 bp, Homo sapiens
tggaagcaactaaatcataagaatgcaaaacatgttctttattccaac

SEQ ID NO: 2331 - DNA, 132 bp, Homo sapiens
cacccaagacaaggagttttagtatctcttggggtggacccaaatgcctcccacatggctctgctgagagagacagagagcctcatctacccaaaagcaaccaactggcaacctctcctatctggaatcagg

SEQ ID NO: 2332 - DNA, 140 bp, Homo sapiens
cagcacatggaaagagcgtctctgctttgaacagagccaacttcggagccagctggcaaactgctgacaagcacacatgctcagaaaggcaggcaagatgaggggaaaagacattgctgactcacaagtgccaaatttta

SEQ ID NO: 2333 - DNA, 97 bp, Homo sapiens
atcgccttcacctccaggtcaaagaagctgtggattcagttcaagtccaatgaagggaacagcgctagagggttccaggtcccatacgtgacatatg

SEQ ID NO: 2334 - DNA, 845 bp, Homo sapiens
tactagttctatgatctcgggcacacattctgaatctttctgcacttgtcttctcatctgttaaaatggggctagtaacagttgctaccttataaggttataagggctaaaggagttcatagatgtgaaacacttagaataggccaggcacagtggctcacacctgtaatcccaggctgagggaggaggctgaaccaggattttgtgaccaggctcggtgagaccctgtctctatacatttttttttttttaattagctgggcatgatggtgcatgcctgtggttccggctactcgggaggctgagatgggtgaatcgcttaagcctgggaggtggaggatgcagtgagccgtgatcatgccactgcactccagcctggtagacagagccagaccttgtctcaaaaaacaaacaaacaaacaaacaaacaaacaaacaaagaatgatgatgacacatggagccactatataaacgtttgctcttcttattagtggttaaaatgtctgaagtcaagtataggtttaaatccttgttttaccacatactggctatatgaccctgggcaagtatttaatctctctattaaaaaggtaacggttgcaccaactttctgtggttttcagaagattaaatgagacaaagtccataaattgcctagcatgctgcctgatcttaggcagcaaatggtggtgatgacaattagatgacagcaggtcagttctggaatgggaggccctcacccagctcctacagtgaacggtacagcctgggctgctgctgcttgccaagccccaggtctttcaggtgtagcctcccctgggggtccacaattaccagctgaatc

SEQ ID NO: 2335 - DNA, 152 bp, Homo sapiens
gctgggagatttcactgggtacattgaatccccaaactacccaggcaattacccagccaacaccgagtgtacgtggaccatcaacccaccccccaagcgccgcatcctgatcgtggtccctgagatcttcctgcccatagaggacgactgtg

SEQ ID NO: 2336 - DNA, 122 bp, Homo sapiens
tcaccgatgtattcgttgcccagtgggaacataccagcctgaatttggaaaaaataattgtgtttcttgcccaggaaatactacgactgactttgatggctccacaaacataacccagtgta

SEQ ID NO: 2337 - DNA, 138 bp, Homo sapiens
gtcaacctggtgaatattctgcagatggctttgcaccttgccatctctgtgccctgggcacgttccagcctgaagctggtcgaacttcctgcttcccctgtggaggaggccttgccaccaaacatcagggagctactt

SEQ ID NO: 2338 - DNA, 96 bp, Homo sapiens
ctgggacctattatgatggagcacgagaacgctgcattttatgtccaaatggaaccttccaaaatgaggaaggacaaatgacttgtgaaccatgcc

SEQ ID NO: 2339 - DNA, 125 bp, Homo sapiens
cctgagctgcatcgtaaagcgaaccgagaagcggctccgtaaagccatccgcacgctcagaaaggccgtccacagggagcagtttcacctccagctctcaggcatgaacctcgacgtggctaaaa

SEQ ID NO: 2340 - DNA, 135 bp, Homo sapiens
gagagcttccgctacgtaaaccttacatgcagctctggcaagcaagtcccaggagcccctggccgaccaagcacccctaaggaaatgtttatcactgttgagtttgagcttgaaactaaccaaaaggaggtgaca

SEQ ID NO: 2341 - DNA, 98 bp, Homo sapiens
ccaccatcaggacaagtgtaacctttaagctaaatgaaggcaagtgtagtttgaaaaatgctgagctgtttcccgagggtctgcgaccagcactacca

SEQ ID NO: 2342 - DNA, 27 bp, Homo sapiens
cctactctgtcacctgtggctcttcct

SEQ ID NO: 2343 - DNA, 30 bp, Homo sapiens
tggtggaggagacgggtgcttcctcagatg

SEQ ID NO: 2344 - DNA, 39 bp, Homo sapiens
tgcccacaagtgtgtcaccccgtgtgtccctgcactgcg

SEQ ID NO: 2345 - DNA, 109 bp, Homo sapiens
accaatgagtgcagcatcaacaacggaggctgtcagcaggtctgtgtgaacacagtgggcagctatgaatgccagtgccaccctgggtacaagctccactggaataaaa

SEQ ID NO: 2346 - DNA, 59 bp, Homo sapiens
accaccctggcacatttgcttgtgcttgcaaccgagggtacaccctgtatggcttcacc

SEQ ID NO: 2347 - DNA, 83 bp, Homo sapiens
atgagtgccagacccgcaatggaggttgtgatcatttctgcaaaaacatcgtgggcagttttgactgcggctgcaagaaagga

SEQ ID NO: 2348 - DNA, 101 bp, Homo sapiens
aacgtgtgctgtcaacaatggaggctgtgaccgcacctgtaaggatacttcgacaggtgtccactgcagttgtcctgttggattcactctccagttggatg

SEQ ID NO: 2349 - DNA, 51 bp, Homo sapiens
ggtgacagagagcaacaccacatcagtggtggatggggataaacgggtgaa

SEQ ID NO: 2350 - DNA, 84 bp, Homo sapiens
tgcatgaataaggatcacggctgtagtcacatctgcaaggaggccccaaggggcagcgtcgcctgtgagtgcaggcctggtttt

SEQ ID NO: 2351 - DNA, 105 bp, Homo sapiens
ggctgccagcatacctgtgtcaacgtcatggggagctatgagtgctgctgcaaggaggggtttttcctgagtgacaatcagcacacctgcattcaccgctcggaa

SEQ ID NO: 2352 - DNA, 104 bp, Homo sapiens
tgtggaaatgagctcaatggaggctgtgtccatgactgtttgaatattccaggcaattatcgttgcacttgttttgatggcttcatgttggctcatgacggtca

SEQ ID NO: 2353 - DNA, 99 bp, Homo sapiens
tgtgcccaagggctagatgactgccatgccgacgccctgtgtcagaacacacccacctcctacaagtgctcctgcaagcctggctaccaaggggaaggc

SEQ ID NO: 2354 - DNA, 105 bp, Homo sapiens
ccggggcggcctgggcggtgctgctgctgctgctgctgctgccgccactgctgctgctggcgggggccgtcccgccgggtcggggccgtgccgcggggccgcagg

SEQ ID NO: 2355 - DNA, 49 bp, Homo sapiens
cgccaccgcccgcactccgccgcctctgcccgcaaccgctgagccatcc

SEQ ID NO: 2356 - DNA, 114 bp, Homo sapiens
ggcccagagagctgcagcgcagcgtcctgcctgcagagggggtgagaggccacactgcagccgtctgcctggagcccacggacagagctttagttctctcggagaaggccgagg

SEQ ID NO: 2357 - DNA, 207 bp, Homo sapiens
cacctgcagttaaaggaataccttccgcgaggcggcttttcggagcatgcatgtttatagctccagccaggccagaccgagggctgctgcataagccctgcttggtgcatttctttacttgcaaggggacagagtgtgggcttaggtttgggactagagggggctttggcaactatggtgctcaggtgattatccttcgctcgttta

SEQ ID NO: 2358 - DNA, 34 bp, Homo sapiens
cagcagccaagccggggcagtttcagtctccacc

SEQ ID NO: 2359 - DNA, 146 bp, Homo sapiens
ccagccagtttggtgctgacggtgagaggaaattagaatctgtttgcaaattgtccaacccaccccctcaacatgaggggcttccattttctgtgttttgtaagggaactgtttccttcatgccgccatgttcctgatattagttc

SEQ ID NO: 2360 - DNA, 206 bp, Homo sapiens
gggaaacacaccgactgcctcagcaatcatgcaaagaccttgcctggcccggtggcaagcgctgaaaaaccgaccgcctgtaggctcctggaactatacagataggtaaagagttccaagttcgtccagcccatgtgcaaagtcaacagtatttgccttaagatttcatatatatatatttttttgcattgactgctgagagctcc

SEQ ID NO: 2361 - DNA, 157 bp, Homo sapiens
gctgaaattcggtacctttggtggattggggtcaaagagcaaaggtcattatgaggtgactgggagcgatgatgagacaggcaagttacaggggagtggggtgtccctggcctctaagaagtcccgactgtcctcctcttctagcaatgacagtggg

SEQ ID NO: 2362 - DNA, 1879 bp, Homo sapiens
cacgtctggatttcgaaggccctgatgccaaactcagtggcccatctttgaagatgccatcgctggagatatctgctcctaaagtaactgctcctgatgttgatttgcatctcaaggcaccaaaaattggattttcaggtccgaagttagaaggtggtgaagtggacctcaagggacccaaagttgaagctccaagcttagatgtacacatggacagcccagatattaacatcgaagggccagatgttaaaatccccaaatttaagaaacccaagtttggatttggggcaaaaagccccaaagctgacatcaagtcaccttcactggatgtcactgttcctgaggcagagctgaaccttgagactcctgaaattagtgttggtggcaagggcaagaaaagtaagtttaaaatgcctaaaattcatatgagtggtcctaagattaaggccaaaaaacagggatttgacctgaatgttcctgggggtgaaattgatgccagcctcaaggctccggatgtagatgtcaacatcgcagggccggatgctgcactcaaagtcgacgtgaaatcgcccaaaaccaagaaaacgatgtttggaaaaatgtacttcccagatgtagagtttgacattaaatcacctaaatttaaagctgaggcccctctccctagccccaaactggagggtgaactccaggcacctgatctggaactttctttgccagcgattcacgtcgaaggtcttgacatcaaggcgaaggctcccaaggtcaagatgccagatgtggacatctcagtgccaaaaatagagggtgacctgaaaggccccaaagtgcaggcaaacttgggtgcacctgacatcaacatcgaaggcctagatgctaaagtcaaaacaccgtccttcggcatttctgcccctcaagtctccatccctgatgtgaatgtaaacttgaaaggaccaaagataaagggtgatgtccccagcgtgggactggaaggaccagatgtagatctgcaaggtccagaagcaaaaattaagttccccaagttttccatgcccaagatcggcatcccaggtgtgaaaatggagggtgggggagccgaggtccatgcccagctaccctctcttgaaggagacttgagaggaccagatgttaagctcgaagggcccgatgtttctctaaaggggccaggagtagacttgccttcagtgaacctctctatgccaaaagtctctgggcctgaccttgatctgaacttgaaaggaccaagtttgaagggagacctggatgcatctgttcccagcatgaaggtgcatgctccagggctcaacctcagtggtgtcggtggcaaaatgcaggtgggaggagacggtgtgaaagtgccagggatcgatgccacaacaaagcttaacgttggggcaccagatgtgacactgaggggaccaagcctgcagggagatctggctgtctctggtgacatcaaatgccctaaagtatccgtaggagctcctgatctaagcttggaggcatccgaaggcagcattaaacttcccaaaatgaagctgccccaatttggcatctctactccggggtccgacttgcacgtcaatgccaaggggccacaggtttctggcgaactgaaggggccaggtgtggatgtgaacctgaaagggcctcggatttcagcaccgaatgtggactttaacttggaaggaccaaaagtgaaagggagccttggggccactggtgagatcaaaggccccactgtcggaggaggtcttccaggcattggtgttcaaggcctagaaggaaacctccagatgcctggaattaagtcctctggatgtgatgtgaacctgccaggcgtgaatgtgaaactccc

SEQ ID NO: 2363 - DNA, 53 bp, Homo sapiens
gtccagacgcaaaactgaagggccccaagttcaagatgcctgaaataaatatc

SEQ ID NO: 2364 - DNA, 34 bp, Homo sapiens
gcccaaggccgacatcgatgtctcgggacccaag

SEQ ID NO: 2365 - DNA, 76 bp, Homo sapiens
atgtggatgttcatggcccagactggcacctgaagatgcccaaggtgaaaatgcccaaattcagcatgcctggctt

SEQ ID NO: 2366 - DNA, 106 bp, Homo sapiens
tggatgtgaacctgcccaaggctgacattgatgtctcaggacccaaagtggacgttgatgttcctgatgtgaatatcgaaggtccagatgcgaaactaaagggccc

SEQ ID NO: 2367 - DNA, 27 bp, Homo sapiens
taaaaatgcccaaagtgaaaatgccca

SEQ ID NO: 2368 - DNA, 161 bp, Homo sapiens
gtgggcattgacactcctgatattgacattcatggtccagaagggaaactgaagggccccaaatttaaaatgcctgacttacacctcaaggcaccgaagatctctatgcctgaagttgacctgaatctgaaaggtccaaaggtgaagggcgacatggacat

SEQ ID NO: 2369 - DNA, 43 bp, Homo sapiens
aaaggagatatggacatttccgttcctaaactggagggagatc

SEQ ID NO: 2370 - DNA, 25 bp, Homo sapiens
tagacattgaaggtcctgaagggaa

SEQ ID NO: 2371 - DNA, 80 bp, Homo sapiens
aagggccctgaaattgacataaaaggccccagtttggacattgacacacctgatgtcaatattgaaggtccggaaggaaa

SEQ ID NO: 2372 - DNA, 108 bp, Homo sapiens
ttcctaaggctgacattgagatttctggccccaaagtggacattgatgcccctgatgtcagtatcgaaggtccagatgcaaaactcaagggtccaaagttcaagatgc

SEQ ID NO: 2373 - DNA, 141 bp, Homo sapiens
atgtggacgttcaaggcccagactggcacttaaaaatgcccaaagtgaaaatgcccaagttcagcatgcctggcttcaaaggagagggcccagatgtggatgtgaacctgcccaaggctgaccttgacgtctcaggaccca

SEQ ID NO: 2374 - DNA, 213 bp, Homo sapiens
agatgtggatgtttctctgcctaagatggaaggtgatctaaaggcccctgaagttgacatcaagggccccaaagtggacattgatgccccagatgtggatgttcatggcccagactggcacctgaagatgcccaaggtgaaaatgcccaaattcagcatgccaggatttaaaggagagggcccagaagtggatgttaatttgcccaaagctga

SEQ ID NO: 2375 - DNA, 33 bp, Homo sapiens
gtgacatgcaagttcctgacttggatattaaag

SEQ ID NO: 2376 - DNA, 107 bp, Homo sapiens
ggcccagactggcacctgaagatgcccaaggtgaaaatgcccaagttcagcatgcctggcttcaaaggagagggcccagatgtggatgtgaacctgcccaaggctga

SEQ ID NO: 2377 - DNA, 60 bp, Homo sapiens
gtgacctcaagggtcctgaagttgacatcaagggccccaaagtggacattaatgctccag

SEQ ID NO: 2378 - DNA, 26 bp, Homo sapiens
aagggcgatgtggatgtttctctgcc

SEQ ID NO: 2379 - DNA, 55 bp, Homo sapiens
aaatttaagataccagagatgcacctgaaggctcccaaaatatcgatgcctgaca

SEQ ID NO: 2380 - DNA, 29 bp, Homo sapiens
cattgacactcctgacattaacatcgaag

SEQ ID NO: 2381 - DNA, 205 bp, Homo sapiens
ccagaggttgatatcaaaggccctaaagtggacatcaatgccccagatgtggatgttcatggtccagactggcatctgaagatgcccaaagtgaaaatgcccaagttcagcatgcctggcttcaaaggagaaggccctgaagtcgatgttaccctccctaaagctgacattgacatttctggtcccaatgtagacgttgatgttc

SEQ ID NO: 2382 - DNA, 45 bp, Homo sapiens
gtgatgtggatatttctcttcccaaacttgaaggggatctgaaag

SEQ ID NO: 2383 - DNA, 506 bp, Homo sapiens
gcccaaagatagatgtagatgctccagatattgacattcatggcccagatgccaaattaaaaggtccaaaactgaagatgcctgacatgcatgtaaacatgcccaagatctccatgccagaaattgacttgaatttgaaaggctcaaagcttaagggagatgttgatgtctctgggcccaagttggaaggtgacattaaagctcccagtttggatataaagggcccagaagtggacgtttccggtcctaagcttaatatcgaaggcaagtcaaagaaatctcgttttaagcttcccaaatttaatttttcgggctctaaagttcagacacctgaagtggatgtcaaaggtaaaaagccagatattgacataacaggtccaaaagttgatattaatgctcctgatgtcgaggtccaaggaaaagtgaaaggatccaagtttaaaatgcctttcctgagtatttcatctcccaaagtttctatgcctgacgtggagctaaatttgaaa

SEQ ID NO: 2384 - DNA, 105 bp, Homo sapiens
ccaagatcagcatgcctggcttcaaaggagaaggtccagaagtggacgtgaacctgcccaaggctgaccttgacgtctcaggacccaaggtggacgttgatgttc

SEQ ID NO: 2385 - DNA, 223 bp, Homo sapiens
gcccaaattcagcatgcctggcttcaaaggagagggcccagatgtggatgtgaacctgcccaaggctgaccttgatgtctcaggacccaaggtggacattgatgttccagatgtgaatatcgaaggcccagagggaaagttgaaaggtcccaaattcaaaatgcctgagatgaacatcaaagcccccaagatctccatgcctgacattgatcttaacctgaaa

SEQ ID NO: 2386 - DNA, 570 bp, Homo sapiens
tggacattgacgcacctgatgttgatgttcatggcccagactggcacctaaagatgcccaagataaaaatgcccaagatcagcatgcctggcttcaaaggagaaggtccagatgtggacgtgaacctgcccaaggctgacattgatgtctcaggaccgaaagtggatgttgaatgtcccgatgtgaatatcgaaggacctgaaggaaagtggaaaagtccaaagtttaagatgccagagatgcattttaagactccaaagatatccatgccagatattgacctgaatctcacaggtccaaaaataaaaggagatgtggatgttacaggccctaaggtagagggagatctgaaaggtcctgaagttgacctcaaaggccccaaagtggacattgatgtcccagatgttaatgttcagggtccagactggcacctgaagatgcccaagatgaaaatgcccaagttcagcatgcctggcttcaaagcagagggccctgaagtggatgtgaacctgcccaaggctgacgttgatgtctcaggccccaaagtggacgttgaaggccctgatgtta

SEQ ID NO: 2387 - DNA, 25 bp, Homo sapiens
gtggaaggtgacctcaagggcccag

SEQ ID NO: 2388 - DNA, 25 bp, Homo sapiens
aaaggacccaaagtgaagggtgatg

SEQ ID NO: 2389 - DNA, 106 bp, Homo sapiens
agagggccctgaagtagacgtcaacttgcctaaggctgacgttgacatctcaggacccaaggtggacattgaaggccctgatgttaatattgaaggaccagaggga

SEQ ID NO: 2390 - DNA, 78 bp, Homo sapiens
aagtaccagatatgaacatcaggggccccaaagttgatgtaaatgcccccgatgtccaagctccagactggcacctga

SEQ ID NO: 2391 - DNA, 156 bp, Homo sapiens
actcctaagttcaagatgccagatatgcactttaaagctcccaaaatctctatgccagacctcgatctacacttgaagagccccaaggcaaaaggagaggtggatgtagatgttcccaaattggaaggggaccttaaagggccacatgtggatgtc

SEQ ID NO: 2392 - DNA, 45 bp, Homo sapiens
cagaattggatgtcaaaggtcccaaattagatgctgacatgccag

SEQ ID NO: 2393 - DNA, 73 bp, Homo sapiens
ctccatgcctgatgttgatttcaatttaaagggacccaaaatcaaaggagatgttgatgtttctgccccaaag

SEQ ID NO: 2394 - DNA, 26 bp, Homo sapiens
gttcccaaggtagaaggtgaaatgaa

SEQ ID NO: 2395 - DNA, 166 bp, Homo sapiens
tgagatgcacttcaaggcccccaagatctccatgcctgatgtggacttacacttgaaaggccccaaagtcaaaggggatgtggatgtgtctttgccaaaattggagggagatttaacaggccccagtgtggatgtggaggtgcctgatgttgagctggagtgtcct

SEQ ID NO: 2396 - DNA, 28 bp, Homo sapiens
gcccaagttcagcatgcctggcttcaaa

SEQ ID NO: 2397 - DNA, 32 bp, Homo sapiens
cattgatgccccagatgtggatgttcatggcc

SEQ ID NO: 2398 - DNA, 315 bp, Homo sapiens
ccgcaagttgatgtcaaaggtccttttgtggaagcggaggtgcccgatgttgatctggagtgtcctgatgcaaagttgaaagggcccaagtttaagatgcctgagatgcacttcaaggcccccaagatctccatgcctgatgtggacttacacctgaaaggccccaaagtcaaaggggatgcggatgtgtcggtgccaaaattggagggagatttaacaggccccagtgtgggtgtggaggtgcctgatgttgagctggagtgtcctgatgcaaagttgaaaggccctaaatttaagatgccagacatgcacttc

SEQ ID NO: 2399 - DNA, 314 bp, Homo sapiens
atgtggaggttcacgacccagattggcacctgaaaatgcccaagatgaaaatgcccaagttcagtatgcctggcttcaaagcagagggccctgaagtggatgtgaatctgccaaaggctgacattgatgtgtctggacccagtgtggacactgatgctcctgatttggatattgagggaccagaaggaaagttgaaaggctccaaatttaagatgcccaagttgaatataaaagctcccaaggtctccatgccagatgtggacttgaatttgaagggacccaaactgaagggagagatagatgcttctgtgcca

SEQ ID NO: 2400 - DNA, 834 bp, Homo sapiens
gcctgatgtggacctgaatcttaaggggccaaaattgaagggagatgtggatgtgtccttgcctgaggtagaaggtgaaatgaaagtgccagatgttgacattaaagggcccaaagttgacattagtgctccagatgtggatgttcatggcccagattggcacctgaagatgcccaaggtgaaaatgcccaagttcagcatgcccggcttcaaaggagagggccctgaagtggatgtgaagctgcccaaagctgacgttgatgtctcaggacccaaaatggatgctgaagttccagatgtgaatattgaaggtccagacgcaaaactaaaaggtcccaaattcaagatgccagaaatgagtataaagcctcagaagatatccataccagatgttggtttgcatttgaaaggtcctaaaatgaaaggagattatgatgtaacagttccaaaagtagaaggagagataaaagctcctgatgttgacatcaaaggccccaaagttgatattaatgcaccagatgtggaggttcatggcccagactggcacctgaagatgcccaaggtaaaaatgcccaagttcagcatgcctggctttaaaggagagggcccagaggtggatatgaacctgcccaaggctgaccttggtgtttcaggacccaaggtggacattgatgttccagatgtgaatcttgaagctccagaggggaaactaaaaggccctaagttcaagatgccaagcatgaatatacagacgcacaaaatctctatgcctgatgttggacttaatttgaaagcccctaaactgaaaactgatgtagatgtttcccttcccaa

SEQ ID NO: 2401 - DNA, 2647 bp, Homo sapiens
gacccagagccgtaccatcacagtgaccagaagggtcacggcctacactgtggatgtgactggccgggaaggagccaaggacatagacatcagtagccctgaattcaagatcaagattccaagacatgaactgactgaaatctccaatgtggatgtggagacccagtctgggaagaccgtgatcagactgccctcgggctcgggggcagcctctccgacaggctctgctgtggatatccgagcaggggccatttctgcttcaggaccagagctccaaggtgctggccactcgaagctccaggtcaccatgcctgggataaaggtgggaggctcaggtgtcaatgtcaatgcaaagggcttggacttgggtggcagaggaggggtccaagttccagcagtggacatttcatcttctcttgggggtagggcagtagaggtacagggcccatctctggagagtggtgatcatggcaaaattaaatttcccaccatgaaagtgccgaaatttggtgtctcaacagggcgtgagggccagacaccaaaggcagggctgagggtttctgcacctgaagtctctgtggggcacaagggcggcaagccaggcttgactatccaagcccctcagctggaagtcagtgtgccctctgccaatattgagggccttgaggggaagctgaagggcccccaaatcactgggccatcacttgagggtgacctaggcctgaaaggtgccaagccacaggggcacattggggtggatgcctctgctccccaaattgggggtagcatcactggccccagtgtggaagttcaggcccctgacattgatgttcaggggcctgggagcaaactgaatgtgcccaagatgaaagtccccaagttctctgtatcaggtgcaaagggagaggaaactgggattgatgtgacactgcctacaggtgaagtgactgttcctggggtctctggggatgtcagcctgcctgagattgctactggtgggctggaaggaaagatgaaaggtactaaagtgaagactcctgaaatgattattcagaaacctaaaatctccatgcaggatgtggatctgagccttgggtctcctaaactgaaaggagatattaaggtttctgctcctggggtgcaaggtgatgttaaaggccctcaagtggcacttaaaggctccagagtggacatagagacaccaaacctagagggaaccttgacaggccctaggcttggcagtccttccgggaaaaccggaacctgtaggatctctatgtcagaagtagacttaaatgtggccgcacctaaagtgaaagggggtgtagatgtcacactccccagagtagaagggaaagtcaaagtccctgaagttgatgtcagaggccccaaagtggatgtcagtgccccagatgtcgaagcgcatggcccagaatggaacctgaaaatgcccaagatgaaaatgcccacgttcagcactccaggagccaaaggggaaggtccagatgttcatatgactctacccaaaggagatatcagtatttcagggcccaaggtcaatgtggaagccccagatgtcaacttggagggtctggggggaaaacttaaaggccccgatgttaagctgcctgatatgagtgtcaagacaccaaagatctccatgcctgatgtagatttgcacgtgaaaggtacaaaggtgaagggagagtatgatgtaactgtaccaaagctggaaggagaactcaaaggcccaaaagtggacattgatgccccagatgtggatgttcatggcccagactggcacttgaagatgcccaagatgaaaatgcccaaattcagtgtgccagggttcaaagcagagggcccagaagtggatgtgaacctgcccaaggctgatgtggacatttccgggcccaagatagatgttactgctcctgatgtgagcattgaggaaccagaagggaaattgaaagggcccaagtttaagatgcctgagatgaacatcaaagtccccaagatctccatgcctgatgtggacttacatctgaaaggccctaacgtaaagggagaatatgatgtcacaatgccaaaggttgaaagtgagattaaagttcctgatgttgaacttaaaagtgccaaaatggacattgatgtcccagatgtggaggttcaaggcccagactggcacctgaagatgcccaagatgaaaatgcccaagttcagcatgcctggcttcaaagcagagggcccagaagtggatgtgaacctgcccaaggctgatgtggacatctcaggacccaaggtgggtgttgaagttccagatgtgaatattgaaggacctgaaggaaagctgaagggccccaagttcaagatgccagagatgaatatcaaggcccccaagatctccatgcctgatgtggacttgcatatgaaaggtcctaaagtaaagggagaatatgatatgacagtgccaaagctggaaggggacctgaaaggcccaaaagtagatgtcagtgccccagatgttgaaatgcagggtcctgactggaacttgaagatgccaaagattaaaatgcccaaatttagcatgcccagcctcaaaggagaggggccagaatttgatgtgaacctgtccaaagcgaatgtg

SEQ ID NO: 2402 - DNA, 147 bp, Homo sapiens
gggtgccaccatctactttgacaacctgcagtcgggtgaggtgacccagctgctgaacaccatggggcaccacacggtgggcctgaagctgcaccgcaagggggaccgctctcccgagcctggccagacctggacccgtgaagtctt

SEQ ID NO: 2403 - DNA, 111 bp, Homo sapiens
aaggaggagacaacccgggagctgctgctgcccaactggcagggtagtggctcccacgggctgaccatcgcccagagggacgacggcgtctttgtgcaggaggtgacgcag

SEQ ID NO: 2404 - DNA, 425 bp, Homo sapiens
ccagagcattaaacatggggtattgttaagaagcaaaatgttcttgtttgccatcatgtgtttcacaccacaattctgtgccacagttaagagggtctggtacccttgcaggacctttgtaggttgtgggaaaaagtcgcagaaagatactcaaagtggagcagggaatggagacagacatcagtgatgataaaaaaaaaaatggaccttaagaaactatttactctgtaatctctaataaaatatggaattccatattagggcaatgagactgaaactactggtgtttttctgccttgagaaaacaaacagttaaaacaagcctcaaatgtattttagtgccacccactggccataggtacaattcagttgttggcttgttttgacttaattctaaaataggtctcaagcctgtatttttatga

SEQ ID NO: 2405 - DNA, 130 bp, Homo sapiens
ctactaaaccggtggaatctgatcttgaaaatctgagtaggtggacaaatatcctcactttctatctattgcacctaaggaatactacacagcatgtaaaagtcaatctgcatgtgcttctttgattaca

SEQ ID NO: 2406 - DNA, 111 bp, Homo sapiens
tggactctacttcagaggaagttgctctctgggagaagatggtaaactcccccaatacttggattgaagcaacactgcctctcagaatgcttttgattgccaagatttcca

SEQ ID NO: 2407 - DNA, 122 bp, Homo sapiens
ctatggtgtatgatgggttcaggcctgaagatctgatggaagcctgtgtagagcttactgtctgggaccattacaaattaaccaaccaatttttgggaggtcttcgtattggctttggaaca

SEQ ID NO: 2408 - DNA, 83 bp, Homo sapiens
aagcttcctacaactggagaagtgcacatctgggtgaaggaatgccttgatctaccactgctaaggggaagtcatctaaattc

SEQ ID NO: 2409 - DNA, 28 bp, Homo sapiens
aatgaaactagctctccagtatgtccca

SEQ ID NO: 2410 - DNA, 142 bp, Homo sapiens
cacagaaattgaacctgtccatttggcatcgggatacatttaagcgcaatagtttcctaggggaggtggaacttgatttggaaacatgggactgggataacaaacagaataaacaattgagatggtaccctctgaagcggaa

SEQ ID NO: 2411 - DNA, 25 bp, Homo sapiens
ttgcccaggctggcacgatctcagc

SEQ ID NO: 2412 - DNA, 155 bp, Homo sapiens
gtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcaga

SEQ ID NO: 2413 - DNA, 52 bp, Homo sapiens
gagctctttaaccaatcttagcagctcctctggcatgacgtccttgtcttct

SEQ ID NO: 2414 - DNA, 30 bp, Homo sapiens
atgagcaagtctgttccagcatttctccaa

SEQ ID NO: 2415 - DNA, 44 bp, Homo sapiens
tgcctacacaacctgataatccattttctcaccctgacaaactc

SEQ ID NO: 2416 - DNA, 514 bp, Homo sapiens
accattctaactttgccttgggatattgaaaattctgaatcagtgaggtatctaaataatttatattttcaaaaaataatgtttattttataattctgagtgtaaaacactatcagaaaagtaatcctcatgctcactaaacaaacctactctaagacactcaacaaccagaacagttttattattgagttgtgtacaaaaatcttgactgtccagatgaaatagtttttcagcctgcagtgtgttagtgatatatctcaaggagatgaaccaataaagtacagactttgtggtctgaagctctgttgtgaaaaaataagctaaaccaattcacactgacagtataatttgattcaagtgcagctccagttcaataaaaactaatgtttttaaaattaactttgttttgtatttggttcaactccttgctagttctctctctatataatttataaaaactgcatgttgctaatctcatgatcctgtgcatgtggactactctgcctttaacttt

SEQ ID NO: 2417 - DNA, 26 bp, Homo sapiens
agttacaaatgaatgcgtaccaagaa

SEQ ID NO: 2418 - DNA, 116 bp, Homo sapiens
cctgtcagatgtattctgctgtctcagttgtgaaactgacatttgagctttactttcatgtctctttaatccttctgttaaaatggtatttattctcaatgttgccctcctgagta

SEQ ID NO: 2419 - DNA, 41 bp, Homo sapiens
aagtagataatcagccagaagaattagtgcgtagtgctgaa

SEQ ID NO: 2420 - DNA, 96 bp, Homo sapiens
ggttgcacccctcattgcatcttgactaattgcttccaactccgggggcttccagggacaatctcattgttcttttctctccaagggtcagccatg

SEQ ID NO: 2421 - DNA, 93 bp, Homo sapiens
tgccaagattccacttagcagctggtccccagttacatctcttcagttgacttcccaagcaagcctcccagaggcatatgtgaatgatgatgc

SEQ ID NO: 2422 - DNA, 72 bp, Homo sapiens
aaactttggaaaggagtgccgctaggaaaatgccttccaaaagtctagaagacatttcatcagattcatcaa

SEQ ID NO: 2423 - DNA, 34 bp, Homo sapiens
atggaaacaccagttctaatgcagagagctggag

SEQ ID NO: 2424 - DNA, 81 bp, Homo sapiens
gtaaagttgaattgactctagcatcgccatatatgaaacaagagaaagaggaagaaaaagaaggtttctctgagtctgatt

SEQ ID NO: 2425 - DNA, 45 bp, Homo sapiens
ctgaagcaattagtgtgtccagaaataggcaacccattcctctcc

SEQ ID NO: 2426 - DNA, 126 bp, Homo sapiens
agatttttgtggttccagaagtggagttgagatccctagaaccccacaactttatgtggctcatgaaatagggaccattaaaactgtaacccccccagaggacagggacagtgaaagtggggttgc

SEQ ID NO: 2427 - DNA, 72 bp, Homo sapiens
gtaatggtttggaatctcaagtcaaccaatgtgataaaatgttgggaggagacgcacttgtgactgatttat

SEQ ID NO: 2428 - DNA, 29 bp, Homo sapiens
ctcacagacctctgaaatgaaggataaaa

SEQ ID NO: 2429 - DNA, 218 bp, Homo sapiens
ataggtagtacagaggagcccaggcgagccacttctgaatgccatcctgaggaattaaaagaaacagtagaaaaggccgaggctccgttaataactgagagtgcttttgatgctggttttgagaaacttcttaaagaaataactgaagctcctccttatcagccccaggtgtcagtgagagaagaaactcacgagaaggagtcctcacagtcagagca

SEQ ID NO: 2430 - DNA, 33 bp, Homo sapiens
gtgagggaaacaattgttcaacccaaatcagag

SEQ ID NO: 2431 - DNA, 166 bp, Homo sapiens
tgggctacgatggacaccatagttccagacaggaaggatttttattcctccaatgtagttcctgataaaactcatgaagttggatcttatttagctgcccaaatgtctccatcagaccagacgcttagctcatttgcttccattgttgctcaatatggcaaaggcc

SEQ ID NO: 2432 - DNA, 100 bp, Homo sapiens
aagtatggttaagttatccagctggaagggaagtaggtcctggagaagtgaacccagaatttcctgaagcagtacagccagtatgtagccccctaaatcc

SEQ ID NO: 2433 - DNA, 186 bp, Homo sapiens
tccattggatccaacttcccagctttccagaaagggttcttttggggatgtggccagccctccccaagatatgctttttccccaggatgctcatcttgttccccaggctagggtacacccttctcaaacggaaatttcggagactgtagagaaagtcattcttccacccagacctgtattgaatga

SEQ ID NO: 2434 - DNA, 657 bp, Homo sapiens
ttcaaagggcatactccaggtgctaccagatgaaatcacatttcctttgagtccacttagaaagtatacttatcagttgccaggaaatgagtcatcaaaggaaaatgtggaaaagaatacggaagggattgttactccagtgtttaaggaagaaaaggattactcagaacaagagattcaagaatccataataaaaaccaatgttttgtctaaagactgcaaagacacttttaatgacagcttgcagaaactgctttcagaaacctcaacaccagcaattcaaccctctggtggaaaagttcatggaaaacaagtgcttgaaccaagtgtttctgaaaataggacatggcctcaaaaaacagattttgctgatactgaggaagaagtcaaaggacctgagaagatcattaatgagcatgttgacaaaacagtagttcatccaaaggttaaacggaactctttgactgctagtctagacaaactcctgaaggaagcaactggaacttcaccctctcccttgcaagccaagttggcgcctgttatcactggaaccaactctaagctggaagaggggagattttttggaaaagggatagaacagagtcacaatacttcagctgataagagagaaatactagctccttttccagtgagaga

SEQ ID NO: 2435 - DNA, 400 bp, Homo sapiens
ttctgctaaagcatatcagcctgtgaagaagtcacagggtgtatcatccatggacagtttatctacagaccagagtgaatataatcaggccattcccaaacgagtggtcttagatgaggatgatcaagcatcccagctctccaattcttattcctcaaataaatctaaagagaccaagccacaaatagcaggtccatccagatactatctttcagctgagcaatcagataaagtgtctctgtttcagaataagaaaaatgagcctataaaaagatcacaagtggcagacagtttgccttctagaagaaacattactttaccagcactgcaacctccctcaaatgtcgggagtgaacgacatgctccattggagaaagacagacctctagttcgtgaatca

SEQ ID NO: 2436 - DNA, 60 bp, Homo sapiens
aaccaagtgcagagagagaaatacaaaagagtgagtgacagaatatccttttgggaagga

SEQ ID NO: 2437 - DNA, 501 bp, Homo sapiens
cacgttctggtccatatgccactgagataaagaagtcaactgatgattccatatttaaagttctagactggtttaaccgaagttcttattcagatgacaataagtcattcctccaacatccccgaggaatagagtccaaagaaaaaacagactcaaaatcacaggttgctgttgacttggtgacagatgacactactttaagagaaaatggctcaaagaccctatcacccagcaaaattgaattgaagcctgtgagatctgactcaccattccaagcagagggagatatgctggtttctgaaagttgccaagataataatgtgaatatcaaatccaaattcatgaatttgtcccaaaaaggcaccccaaaggaaggcccaggtatattgcaaccatttgaaagctatggcaccccaagtcaagggagtaaaaatatggactatagccaagattcaaaaagcccaggaaaagggaatggggcatctccttcaaatagtaact

SEQ ID NO: 2438 - DNA, 25 bp, Homo sapiens
taagccccctcctctcccggctcta

SEQ ID NO: 2439 - DNA, 72 bp, Homo sapiens
atgaactgtctcattgtgttgagcctgagccatctcaggtgccaggtggcagttctagagaccgtcagcaag

SEQ ID NO: 2440 - DNA, 25 bp, Homo sapiens
gttgtcactactagattataaaaac

SEQ ID NO: 2441 - DNA, 190 bp, Homo sapiens
gtgaccctaagccttctcaatacagaaagccttcgctttttcatcaatcaacctcaagcccatatgtatcaaaaagtgaaacacatcagccaatgacttctggttcttttccaattaatgggctgcattctcattcagaagttttaactgcaagaccacagtctatggagaattcaccaaccatcaatga

SEQ ID NO: 2442 - DNA, 28 bp, Homo sapiens
gaatttagtgttttagaatctgacagat

SEQ ID NO: 2443 - DNA, 249 bp, Homo sapiens
agagggatcctcaagcgcaactccagttccagtagcacagactcagaaacccttcgttataatcacaactttgaacccaaaagcaaaattgtgtcacctggcctaaccatccatgagagaatttctgagaaggagcattctttagaagacaactcttccccaaactccctggagccattaaagcatgtgagattctctgcagtgaaggatgagcttccacagagtcctgggctaatccatggtcgggaa

SEQ ID NO: 2444 - DNA, 100 bp, Homo sapiens
gaaaagtcaactgtcgcagatacttcaatccaaaagttagagaaatcaaagcagactttgccaggcctttcaaatgggtcccaaatcaaggctccaatcc

SEQ ID NO: 2445 - DNA, 61 bp, Homo sapiens
aggaagaatccgtttaatagctccaagttgccagaaggtcactcatcacaacaaactaaaa

SEQ ID NO: 2446 - DNA, 70 bp, Homo sapiens
cagtgtggtaaatccagcttccagtgtgattgatatgtcccaggaaaacacaaggaaaccaaatgtgtct

SEQ ID NO: 2447 - DNA, 60 bp, Homo sapiens
tccagagctggctggcgttgtagaagagccagaagaagatgcagcaccagcaagcccgag

SEQ ID NO: 2448 - DNA, 122 bp, Homo sapiens
gaaaaaattaaggatgaccagcagctgaagaatatgagtggccaatggttttatgaagccaaggcaaaaaggcacagggacaaaatccatggcgcagatatcatcagagcatctatgagaaa

SEQ ID NO: 2449 - DNA, 50 bp, Homo sapiens
atgaaggttttgcagcgggatgctgctctgaagagggccgaagaagagag

SEQ ID NO: 2450 - DNA, 26 bp, Homo sapiens
atgattgacttaagcttcctgactga

SEQ ID NO: 2451 - DNA, 339 bp, Homo sapiens
tgctgcctcttatgaattgacgacaggtgcagagagagaataaactgtgtctaagactggaccagagagtgagtgtgctggaagccaccataggaacaagcgacctgtttggcaaggaatacagcatccttctgagagcctcttctcgacactatcccacagaccaggacttcctcatgggaaagagcacttaggatcttgctatcagctgccctaaacttttgctgagccaaaataagactttgatgcagaactgaacaagatatttcatttttgtgtgttttaatcttcctggttgcagtcttagttgttcagccctgagaattttgagccacattt

SEQ ID NO: 2452 - DNA, 130 bp, Homo sapiens
agcgtccgtcgggagagtgaaggctcgcaacgccttgcccgggggaaggtaacgcgccgcgcccggggctgcgcggtttgcaccgccaggccgagggctgggggccagaagacaagagagacggcgaggc

SEQ ID NO: 2453 - DNA, 211 bp, Homo sapiens
atggattcatataggccagagttgcaaagatcttttccagagtatgcaactctgacgttgatcccagagagcagcttcagtgacaaacatatcctttcaagacagaaagagacaggagacatgagtctttgccggaggaaaagcagctcaagaacacatgtgcagtcactggtgtcaccctggataggcaagggataactcttctaacaca

SEQ ID NO: 2454 - DNA, 36 bp, Homo sapiens
aaagctaatagctggttcaactgcaggaaaaattga

SEQ ID NO: 2455 - DNA, 90 bp, Homo sapiens
aacgatctatggatccaggttatcccaaaatgatagcacatgactttcctggaattggccacaaagttgatgcagttttcatgaaagatg

SEQ ID NO: 2456 - DNA, 96 bp, Homo sapiens
ataagtactgggctgttcagggacagaatgtgctacacggataccccaaggacatctacagctcctttggcttccctagaactgtgaagcatatcg

SEQ ID NO: 2457 - DNA, 108 bp, Homo sapiens
ttctacccggaagttgagctcaatttcatttctgttttctggccacaactgccaaatgggcttgaagctgcttacgaatttgccgacagagatgaagtccggtttttc

SEQ ID NO: 2458 - DNA, 39 bp, Homo sapiens
gctaacctttgatgctataactacgattcggggagaagt

SEQ ID NO: 2459 - DNA, 55 bp, Homo sapiens
cgttcccaaaatcctgtccagcccatcggcccacaaaccccaaaagcgtgtgaca

SEQ ID NO: 2460 - DNA, 129 bp, Homo sapiens
acttacatcgtgttgcagctcatgaactcggccattctcttggactctcccattctactgatatcggggctttgatgtaccctagctacaccttcagtggtgatgttcagctagctcaggatgacattg

SEQ ID NO: 2461 - DNA, 116 bp, Homo sapiens
gggacaactctccttttgatggacctggaggaaatcttgctcatgcttttcaaccaggcccaggtattggaggggatgctcattttgatgaagatgaaaggtggaccaacaatttc

SEQ ID NO: 2462 - DNA, 26 bp, Homo sapiens
cctcactgaggggaaccctcgctggg

SEQ ID NO: 2463 - DNA, 59 bp, Homo sapiens
gaattctttgggctgaaagtgactgggaaaccagatgctgaaaccctgaaggtgatgaa

SEQ ID NO: 2464 - DNA, 46 bp, Homo sapiens
gcaagttgaaaagcggagaaatagtggcccagtggttgaaaaattg

SEQ ID NO: 2465 - DNA, 26 bp, Homo sapiens
aagagcaagatgtggacttagtccag

SEQ ID NO: 2466 - DNA, 53 bp, Homo sapiens
atgcacagctttcctccactgctgctgctgctgttctggggtgtggtgtctca

SEQ ID NO: 2467 - DNA, 146 bp, Homo sapiens
tgaaatgttcgttttctcctgcctgtgctgtgactcgagtcacactcaagggaacttgagcgtgaatctgtatcttgccggtcatttttatgttattacagggcattcaaatgggctgctgcttagcttgcaccttgtcacataga

SEQ ID NO: 2468 - DNA, 25 bp, Homo sapiens
acagttggagtttgacccaaatgca

SEQ ID NO: 2469 - DNA, 64 bp, Homo sapiens
ggctttcccaagcaaatagctgaagactttccagggattgactcaaagattgatgctgtttttg

SEQ ID NO: 2470 - DNA, 49 bp, Homo sapiens
gcgtggatgccgcatatgaagttactagcaaggacctcgttttcatttt

SEQ ID NO: 2471 - DNA, 44 bp, Homo sapiens
aacctgaattgcatttgatctcttcattttggccatctcttcct

SEQ ID NO: 2472 - DNA, 26 bp, Homo sapiens
tcctgctttgtcctttgatgctgtca

SEQ ID NO: 2473 - DNA, 41 bp, Homo sapiens
tacccacggaacctgtccctccagaacctgggacgccagcc

SEQ ID NO: 2474 - DNA, 66 bp, Homo sapiens
gatgtacccactctatcactcactcacagacctgactcggttccgcctgtctcaagatgatataaa

SEQ ID NO: 2475 - DNA, 25 bp, Homo sapiens
atttatttctcgttgctgctcatga

SEQ ID NO: 2476 - DNA, 32 bp, Homo sapiens
cagggattaatggagatgcccactttgatgat

SEQ ID NO: 2477 - DNA, 25 bp, Homo sapiens
ctggcatcccgaagtggaggaaaac

SEQ ID NO: 2478 - DNA, 151 bp, Homo sapiens
atatctagaaaactactacgacctcaaaaaagatgtgaaacagtttgttaggagaaaggacagtggtcctgttgttaaaaaaatccgagaaatgcagaagttccttggattggaggtgacggggaagctggactccgacactctggaggtg

SEQ ID NO: 2479 - DNA, 27 bp, Homo sapiens
cagcctatccattggatggagctgcaa

SEQ ID NO: 2480 - DNA, 28 bp, Homo sapiens
ccaatcctactgttgctgtgcgtggcag

SEQ ID NO: 2481 - DNA, 73 bp, Homo sapiens
aggttggacctacaaggaggcaggcaagacagcaaggcatagagacaacatagagctaagtaaagccagtgga

SEQ ID NO: 2482 - DNA, 229 bp, Homo sapiens
gtcctcagtgtaccactacttagagatatgtatcataaaaataaaatctgtaaaccataggtaatgattatataaaatacataatatttttcaattttgaaaactctaattgtccattcttgcttgactctactattaagtttgaaaatagttaccttcaaaggccaagagaattctatttgaagcatgctctgtaagttgcttcctaacatccttggactgagaaatt

SEQ ID NO: 2483 - DNA, 91 bp, Homo sapiens
tactactatttcttccaaggatctaaccaatttgaatatgacttcctactccaacgtatcaccaaaacactgaaaagcaatagctggtttg

SEQ ID NO: 2484 - DNA, 75 bp, Homo sapiens
ggagacagatgatggaccctggttatcccaaactgattaccaagaacttccaaggaatcgggcctaaaattgatg

SEQ ID NO: 2485 - DNA, 141 bp, Homo sapiens
ctggttaattagcaatttaagaccagagccaaattatcccaagagcatacattcttttggttttcctaactttgtgaaaaaaattgatgcagctgtttttaacccacgtttttataggacctacttctttgtagataacca

SEQ ID NO: 2486 - DNA, 37 bp, Homo sapiens
tccttatggccaaccttgccatctggcattgaagctg

SEQ ID NO: 2487 - DNA, 34 bp, Homo sapiens
tgatgctgtcactaccgtgggaaataagatcttt

SEQ ID NO: 2488 - DNA, 51 bp, Homo sapiens
ccaaaagagaaccaacgcttgccaaatcctgacaattcagaaccagctctc

SEQ ID NO: 2489 - DNA, 90 bp, Homo sapiens
tagtgatccaaaggccgtaatgttccccacctacaaatatgttgacatcaacacatttcgcctctctgctgatgacatacgtggcattca

SEQ ID NO: 2490 - DNA, 36 bp, Homo sapiens
tcctcactgctgttcacgagattggccattccttag

SEQ ID NO: 2491 - DNA, 105 bp, Homo sapiens
gcttttgatggcaaaggtggaatcctagcccatgcttttggacctggatctggcattggaggggatgcacatttcgatgaggacgaattctggactacacattca

SEQ ID NO: 2492 - DNA, 105 bp, Homo sapiens
cacctgacatgaaccgtgaggatgttgactacgcaatccggaaagctttccaagtatggagtaatgttacccccttgaaattcagcaagattaacacaggcatgg

SEQ ID NO: 2493 - DNA, 89 bp, Homo sapiens
tgggtctgaaagtgaccgggcaactggacacatctaccctggagatgatgcacgcacctcgatgtggagtccccgatgtccatcatttc

SEQ ID NO: 2494 - DNA, 31 bp, Homo sapiens
atgaaatatagtggaaacttaatgaaggaaa

SEQ ID NO: 2495 - DNA, 25 bp, Homo sapiens
agataaacaaacttccagtgacaaa

SEQ ID NO: 2496 - DNA, 28 bp, Homo sapiens
gtttcttctaatactgctcctgcaggcc

SEQ ID NO: 2497 - DNA, 37 bp, Homo sapiens
acacagtaaactgaattgatccgtttagaagtttaca

SEQ ID NO: 2498 - DNA, 169 bp, Homo sapiens
agtctactagattgtgatcccttgagatatggaaggatgcctttttttctctgcatttaaaaaaatcccccagcacttcccacagtgcctattgatacttggggagggtgcttggcacttattgaatatatgatcggccatcaagggaagaactattgtgctcagagac

SEQ ID NO: 2499 - DNA, 425 bp, Homo sapiens
ggatattcagatgtatgtgcccttcttcacacagacactaacgaaatatcaaagtcattaaagacaggagacaaaagagcagtggtaagaatagtagatgtggcctttgaattctgtttaattttcacttttggcaatgactcaaagtctgctctcatataagacaaatattcctttgcatattataaaggataaagaaggatgatgtctttttattaaaatatttcaggttcttcagaagtcacacattacaaagttaaaattgttatcaaaatagtctaaggccatggcatccctttttcataaattatttgattatttaagactaaaagttgcattttaaccctattttacctagctaattatttaattgtccagtttgtcttggatatataggctattttctaaagacttgtatagcatga

SEQ ID NO: 2500 - DNA, 157 bp, Homo sapiens
atatgactatgcgtggctggaaccacattgaagaatgttagagtaatgaaatggaggatctctaaagagcatctgattcttgttgctgtacaaaagcaatggttgatgatacttcccacaccacaaatgggacacatggtctgtcaatgagagcata

SEQ ID NO: 2501 - DNA, 50 bp, Homo sapiens
tacagcatctggagtaaccgtattgttcgcgtcatgccagcaaattccat

SEQ ID NO: 2502 - DNA, 34 bp, Homo sapiens
atatctattttttcaacggacccatacagtttga

SEQ ID NO: 2503 - DNA, 34 bp, Homo sapiens
ctggagttcattgtcgcaatctgagctcgctgca

SEQ ID NO: 2504 - DNA, 35 bp, Homo sapiens
ggataaagactatccgagactaatagaagaagact

SEQ ID NO: 2505 - DNA, 85 bp, Homo sapiens
aaaatatctgaactgggtcttccaaaagaagttaagaagataagtgcagctgttcactttgaggatacaggcaagactctcctgt

SEQ ID NO: 2506 - DNA, 94 bp, Homo sapiens
cctcagcaggttgatgcggagctgtttttaacgaaatcattttggccagaacttcccaaccgtattgatgctgcatatgagcacccttctcatg

SEQ ID NO: 2507 - DNA, 89 bp, Homo sapiens
cctaaacatccaaaaacgccagacaaatgtgacccttccttatcccttgatgccattaccagtctccgaggagaaacaatgatctttaa

SEQ ID NO: 2508 - DNA, 110 bp, Homo sapiens
agttcggccactccttaggtcttgaccactccaaggaccctggagcactcatgtttcctatctacacctacaccggcaaaagccactttatgcttcctgatgacgatgta

SEQ ID NO: 2509 - DNA, 115 bp, Homo sapiens
cattctgaagtcgaaaaggcattcaaaaaagccttcaaagtttggtccgatgtaactcctctgaattttaccagacttcacgatggcattgctgacatcatgatctcttttggaa

SEQ ID NO: 2510 - DNA, 115 bp, Homo sapiens
gctccatgactgagaggctccgagaaatgcagtctttcttcggcttagaggtgactggcaaacttgacgataacaccttagatgtcatgaaaaagccaagatgcggggttcctga

SEQ ID NO: 2511 - DNA, 37 bp, Homo sapiens
agatgatttgtctgaggaagacctccagtttgcagag

SEQ ID NO: 2512 - DNA, 34 bp, Homo sapiens
tcttcttgagctggactcattgtcgggccctgcc

SEQ ID NO: 2513 - DNA, 28 bp, Homo sapiens
caacagtccccaggcatcaccattcaag

SEQ ID NO: 2514 - DNA, 59 bp, Homo sapiens
ttctcccgatccctgagggcggtgagggggaatatcaataattaaagtctgtgggtacc

SEQ ID NO: 2515 - DNA, 114 bp, Homo sapiens
gggatctctgagcacacttgtatgagggctgattctagcaaggggttcctggaaagaccctcgtctgccagcaccgtgacgaccaccaagtccaagctccctatggtcgtgtga

SEQ ID NO: 2516 - DNA, 190 bp, Homo sapiens
agcgggtgcctgcaaccctcaaactccgacatcattcagtgtgtttaggggcaggaggtgttgttcagccgtggaatttgctggtggcagcagtgtaacctgtgtatttgagggtacaggcaagcggtacagggtggagtggctggtccacaagctgtggcagggaagctgtttgcaggactgccctgcc

SEQ ID NO: 2517 - DNA, 101 bp, Homo sapiens
ctgggcgtgctgttgctgtcagttgctgcgttctgcctggtcaggttccagaaagagagggggaagaagcccaaggagacatatgggggtagtgaccttcg

SEQ ID NO: 2518 - DNA, 126 bp, Homo sapiens
agtaatcccttatgcagtcagagtggacaaacctctgtgggaggctctactgcactgagatgcagctcttccgagggggctcctaagccagtgtacaactgggtgcgtcttggaacttttcctaca

SEQ ID NO: 2519 - DNA, 203 bp, Homo sapiens
tgtacttcaccaatggccatctgtatccaactggttctaagtcaaagcgggtcagcctgcttcagaacccccccacagtgggggtggccacactgaaactgactgacgtccacccctcagatactggaacctacctctgccaagtcaacaacccaccagatttctacaccaatgggttggggctaatcaaccttactgtgctg

SEQ ID NO: 2520 - DNA, 53 bp, Homo sapiens
tacagcacgtcggtgggagacagcttcgccctggagtggagctttgtgcagcc

SEQ ID NO: 2521 - DNA, 69 bp, Homo sapiens
ccgtggaggtgaaggtacccacagagccgctgagcacgcccctggggaagacagccgagctgacctgca

SEQ ID NO: 2522 - DNA, 43 bp, Homo sapiens
ccgagctcccggggccctttctctgcggggccctgctaggctt

SEQ ID NO: 2523 - DNA, 51 bp, Homo sapiens
accgaccttgaccgcccacctggcaggagcaggacaggacggccggacgcg

SEQ ID NO: 2524 - DNA, 42 bp, Homo sapiens
ggcggctgcccttgggtgctcccttccctgcccgacacccag

SEQ ID NO: 2525 - DNA, 27 bp, Homo sapiens
aggggcctgaggattagggagacacag

SEQ ID NO: 2526 - DNA, 35 bp, Homo sapiens
gaggagaaggcaagccggaaagagcgaaagaaaga

SEQ ID NO: 2527 - DNA, 46 bp, Homo sapiens
tgggcaaggcatgcagccagcctgaggctactccctctcctggtcc

SEQ ID NO: 2528 - DNA, 31 bp, Homo sapiens
agaagaagaaactgccgaggatggagaggag

SEQ ID NO: 2529 - DNA, 42 bp, Homo sapiens
atgaggaagaagaagaagaggatgatgaagggcccgcgctga

SEQ ID NO: 2530 - DNA, 32 bp, Homo sapiens
tgaagcggatcccaaacggcagaagacagaaa

SEQ ID NO: 2531 - DNA, 116 bp, Homo sapiens
cagccttctcatttccgcctctccagacactgcgccctccaccctcactctgccattgttccacctcctgacctgctccatctgagctctccagctggcccccaattgctcctctc

SEQ ID NO: 2532 - DNA, 85 bp, Homo sapiens
ctctcccacctaacctctgcatcccccagcctcatgtcctgccccatccctatcctgcctgatccctggatctccctcagatccc

SEQ ID NO: 2533 - DNA, 69 bp, Homo sapiens
ttggggccgagccccacagctgcccccctcccctccctttttgtataatttaataaagaaatggtcgcg

SEQ ID NO: 2534 - DNA, 42 bp, Homo sapiens
atgtccatccacttcagctccccggtattcacctcgcgctca

SEQ ID NO: 2535 - DNA, 26 bp, Homo sapiens
agcctctacggcctcggcgcctcacg

SEQ ID NO: 2536 - DNA, 33 bp, Homo sapiens
gccggcatccgcgaggtcaccattaaccagagc

SEQ ID NO: 2537 - DNA, 47 bp, Homo sapiens
ggctggacgccgacccctccctccagcgggtgcgccaggaggagagc

SEQ ID NO: 2538 - DNA, 26 bp, Homo sapiens
gtgcggtttctggagcagcagaacaa

SEQ ID NO: 2539 - DNA, 91 bp, Homo sapiens
gcagaagtcggccaagagcagccgcctcccagacatctttgaggcccagattgctggccttcggggtcagcttgaggcactgcaggtggat

SEQ ID NO: 2540 - DNA, 53 bp, Homo sapiens
gatgaaattaaccaccgcacagctgctgagaatgagtttgtggtgctgaagaa

SEQ ID NO: 2541 - DNA, 74 bp, Homo sapiens
tgagtgggaaagacaggctcgaggagggttgtctgaaaacatgggacaaaggaccacaggatcctctcacctga

SEQ ID NO: 2542 - DNA, 102 bp, Homo sapiens
agtcgctccctggacctggacggcatcatcgctgaggtcaaggcgcagtatgaggagatggccaaatgcagccgggctgaggctgaagcctggtaccagacc

SEQ ID NO: 2543 - DNA, 57 bp, Homo sapiens
cgacctccggaatacccggaatgagatttcagagatgaaccgggccatccagaggct

SEQ ID NO: 2544 - DNA, 30 bp, Homo sapiens
ggcttcccctgctacttggggcatgcaggg

SEQ ID NO: 2545 - DNA, 106 bp, Homo sapiens
ccagctgaggccaaactcaggatgtggagcaggaggttcccatctcccggccaaagctggtgccactgtctcagacccccttgtgagatctccagcacagaatgtt

SEQ ID NO: 2546 - DNA, 53 bp, Homo sapiens
ggcaggcaggaaggcagactggtgagccccagcttacagctgcactgctgccc

SEQ ID NO: 2547 - DNA, 33 bp, Homo sapiens
ctggcgctcaaggatgctcgtgccaagcaggag

SEQ ID NO: 2548 - DNA, 27 bp, Homo sapiens
tgatgaattccactggtggcagtagca

SEQ ID NO: 2549 - DNA, 54 bp, Homo sapiens
aaggcttattccatccggaccgcatccgccagtcgcaggagtgcccgcgactga

SEQ ID NO: 2550 - DNA, 29 bp, Homo sapiens
cagtctggaaagtgatgtcagaatagctt

SEQ ID NO: 2551 - DNA, 32 bp, Homo sapiens
ctgtccgtgtccatgcccggttggccaccccg

SEQ ID NO: 2552 - DNA, 97 bp, Homo sapiens
ggctccgagccgtccacctgtggctccggcttccgaagcggctccggggcgggggcggggcctcactctgcgatataactcgggtcgcgcggctcgc

SEQ ID NO: 2553 - DNA, 32 bp, Homo sapiens
cggcgcccggccggtcagcagcgcggccagcg

SEQ ID NO: 2554 - DNA, 30 bp, Homo sapiens
gctccaccagcttcaggggcggcatggggt

SEQ ID NO: 2555 - DNA, 28 bp, Homo sapiens
caccgggatagccgggggtctggcagga

SEQ ID NO: 2556 - DNA, 67 bp, Homo sapiens
ctgaacgaccgcctggcctcttacctggacagagtgaggagcctggagaccgagaaccggaggctgg

SEQ ID NO: 2557 - DNA, 379 bp, Homo sapiens
gctaaggctgagtcatctaggagtaaacaagaggccttcctttgggaggagccaatccagggtgtagggggcccagagtgaccaggtgcactagggaaaaaatgccaggagagggccaggaagaggacttgttagtagcgactcacttctgggcaggcaggccagccagctagccagcctgctgaggcttcccaagaggggcagagtgctgggatctgggaatccaggaaaggagggaatggggtggggctagatgaaaagggataggtgtccagggagagcctctggctattcctgggaccaggaagttttcactaggatacataacactttttacacactcaccccacccatccctggctttctattcatggaacaa

SEQ ID NO: 2558 - DNA, 30 bp, Homo sapiens
atgcccgcatcgttctgcagattgacaatg

SEQ ID NO: 2559 - DNA, 242 bp, Homo sapiens
ggtggagctaagaaggatctgctccccaggctgggtcagttaggggctcacagtgggatcctgttaggtgtgggtggatgagagtcagggtccatcagtgtattcatttaactgttcatttgtataaccccgtttaagaatactgtcctccaagtgccaagaatggtgctcaggggattaccacctaattgctgactcaagttgctggtttgcaatgggcacagaacttctcttagtaggtg

SEQ ID NO: 2560 - DNA, 45 bp, Homo sapiens
gccatgcgccagtctgtggagaacgacatccatgggctccgcaag

SEQ ID NO: 2561 - DNA, 35 bp, Homo sapiens
tgatgacaccaatatcacacgactgcagctggaga

SEQ ID NO: 2562 - DNA, 38 bp, Homo sapiens
ggctcggaagaaccgagaggagctagacaagtactggt

SEQ ID NO: 2563 - DNA, 29 bp, Homo sapiens
agggaggcagacggaatgaggggcctgat

SEQ ID NO: 2564 - DNA, 61 bp, Homo sapiens
ggtcaccacacagtctgctgaggttggagctgctgagacgacgctcacagagctgagacgt

SEQ ID NO: 2565 - DNA, 48 bp, Homo sapiens
cacatagcaggtgcccaaaaaagtttccaaaagtgaagggatgagcag

SEQ ID NO: 2566 - DNA, 31 bp, Homo sapiens
tcctgggactctgggctcaccctgcccctcc

SEQ ID NO: 2567 - DNA, 29 bp, Homo sapiens
cccgctacgccctacagatggagcagctc

SEQ ID NO: 2568 - DNA, 25 bp, Homo sapiens
tgctggaagatggcgaggactttaa

SEQ ID NO: 2569 - DNA, 346 bp, Homo sapiens
tcctacccacacgtgctgggatcaggagatcacttctccccaaagtctgagcttttggaagcaccccatgtgtctgttcactggtatccactgagcactgggccgttgctccgtgggtgctcctgtgtcttcaagggagtaacagttacagaggtctcccccttgaagaaagcaaactaagtattgtccctagctgtacttagtatgcaaatgaagtttggccttgagtttcccttttctggaggaagaggctgagggtgatttggagataaaggtagaggtcaggaggctttttccctctacctttcttgtctcccttctactccacggggctgtttataacttg

SEQ ID NO: 2570 - DNA, 71 bp, Homo sapiens
gccttggacagcagcaactccatgcaaaccatccaaaagaccaccacccgccggatagtggatggcaaagt

SEQ ID NO: 2571 - DNA, 30 bp, Homo sapiens
ggagcaggaggccaataaaaagttcagagt

SEQ ID NO: 2572 - DNA, 29 bp, Homo sapiens
tgctgccgcggcgggcagacctgcaggag

SEQ ID NO: 2573 - DNA, 84 bp, Homo sapiens
atggagatgccccagaagaccgagattacatggatactctcccaccaactgttggtgatgatgtgggtaaaggagcagcaccaa

SEQ ID NO: 2574 - DNA, 30 bp, Homo sapiens
ttgaaaatcgggcaaatggccagtcaaagg

SEQ ID NO: 2575 - DNA, 132 bp, Homo sapiens
tgcccttgttggtgttggatctgaagcatcttcaaaaaagttaatggatctgttacctaaaagagaacttcatggtcagaatcctgttgtaactccatgcaataaacagttcctgagtcaatttgaaatgca

SEQ ID NO: 2576 - DNA, 27 bp, Homo sapiens
ctacacaatcaggacaaatgtctgggg

SEQ ID NO: 2577 - DNA, 50 bp, Homo sapiens
caggaggcagttcccgtgcagcatttccacaaggtggtagaggacggggc

SEQ ID NO: 2578 - DNA, 97 bp, Homo sapiens
ttaccatggataaaacatgtctacctaatacctcttttccttttctctctttttcaagtaatgcattattaatgtgacttactctccttgttatgct

SEQ ID NO: 2579 - DNA, 92 bp, Homo sapiens
agcatcttgttaaaggaactcggcctttgttcctggaaactaggattccatggcatatggggcacagcatagaggaaatacccatttttggc

SEQ ID NO: 2580 - DNA, 25 bp, Homo sapiens
ccacgtccacccttaggtcctccag

SEQ ID NO: 2581 - DNA, 95 bp, Homo sapiens
ctctagctgggcctcctaatcgaggagatcgccctccaccaccagttctttttcctggacaaccttttgggcagcctccattgggtccacttcct

SEQ ID NO: 2582 - DNA, 115 bp, Homo sapiens
tccgcatgtgaacccagctttctttcctccaccaactaacagtggcatgcctacatcagatagccgaggtccaccaccaacagatccatatgggcgacctccaccatatgatagg

SEQ ID NO: 2583 - DNA, 110 bp, Homo sapiens
ggaaatggatactgcaagaacgccattgagtgaagctgaatttgaagaaatcatgaatagaaatagggcaatctcaagcagtgctatttcgagagctgtgtctgatgcca

SEQ ID NO: 2584 - DNA, 136 bp, Homo sapiens
tgattatgggagtgctattgagacactggtaactgcaatttctttaattaaacaatccaaagtatctgctgatgatcgttgcaaagttcttattagttctttgcaagattgccttcatggaattgagtccaagtct

SEQ ID NO: 2585 - DNA, 78 bp, Homo sapiens
agagggaccatagtagatcacgagaaaagagtcgacgtcataaatcccgtagtagagaccgtcatgacgattattaca

SEQ ID NO: 2586 - DNA, 26 bp, Homo sapiens
tgaccgagagcgcgaatatcgtcatc

SEQ ID NO: 2587 - DNA, 119 bp, Homo sapiens
gaagaggatcaccttccaagacaaaacagtcttcatgggggaaaaatgacgcttgtccagcagtttgcttcttgtgattgaactgaacctgtaaggattcatggataaaatgaacagga

SEQ ID NO: 2588 - DNA, 189 bp, Homo sapiens
tttatttgaaggaaacctgtgtgatttaaaaagttatagcttttgcaactttattactggttatatacatttggccattatgatgtgcaagcaattggaaaaaaagtcaagtaaatgcttgtttttgtagtagtttgttcttgttaaaaatgtttatatgataatgtctgtaaacagcatcactttgat

SEQ ID NO: 2589 - DNA, 34 bp, Homo sapiens
tacaatagatgtagtgttgtaataaactgtttaa

SEQ ID NO: 2590 - DNA, 138 bp, Homo sapiens
ctcagggaaagtcttgtgttcagcaatatctaaagataatgttactatgacaacatttttactgtcctttaaagcattgcaatagcgtttttggatatgcctcaatctaatcttgcgttcagtgaattaaacatagta

SEQ ID NO: 2591 - DNA, 602 bp, Homo sapiens
gcacctgactagcatgtgttcttgattgcaaaattggcagaggcagggtgtcaacttgattaggtgtttttatgggaatgtaatttgaaatcactacttcagaaatttgacttaaaattcttgagcacgttaatatgtttttaagatctgattatctttgagagatcttctgttaatacacattggttgttaaagagtacccaaattctaggacaatgcttaaagtgttaaaataccctagatactgtgttatgtgcaactgtagaaaccctccagaaatttccactgctgttcttcactttcatcttgtctgctatcaaaccacttctgacaaaattagctgttttgaattacccatatcactgccagttttattttaaaatattttgtgtttgaagtatctgtgcatgggatcgttgatgtttatcagaactgttcactttcagaaatgattttttaaagcattttgttgaaaatgcggttgcttttttaacattattttagagttgtatcaaaattttcctgttttctgtatattgttgtgtcatttcttggctttttaatattttgactacaatgccctaatgcgaagaagtatggac

SEQ ID NO: 2592 - DNA, 143 bp, Homo sapiens
actttcgttacagacagtgtgagtgtactagatttgtttgctgctaatccgttattttaagtgttgtcagaaggaaataacttcttggtttgaccaagtaattttgcaaagtccttctctacctgataacacgtgaatgtata

SEQ ID NO: 2593 - DNA, 1074 bp, Homo sapiens
acaagacttttctgttggagtgctctcgacattttggttttcatacctgaatgatcattgcattttctgtattttctaaaatggctccaattttgtgttttaagcttcagcttaagaggaagtttatgttctaattcttgactgagaatacagtattgagattctctgttttacagataacaactggtttttattactcattaagttcatttgcatcccgtagccctctgtaaatgtttcccctagttgtatgtacgtaaatgcacgcttatccagtgtatattagacatttttgtgctaaaatatattaagtgggatttttgtagcaaagcattctatttttctgttcttacagtgtgtgtgtgtgtgtgtgtgtgtgtgtatgcgtttttttaaccttaacttcagtttaaacactggtgtatttatttttttaagcaacttgactcttagaagccttagactgattttttcaataaatattcaaccaaaaattataaatttattaagatgtggccttacatatggcattccttgtgttcgtaatgtgagatttttgatttagataaatcaagattcaggattaaagtttcattgtaagttgaaatagaaaatgtattaaaatgtctaggcttctgggaggaagttcttatactcttctttcttggcattagaaagaagcaatatgaatttttgtgaatattctaaatattcaggcaacactgttcagattgatttaggtttgtcttaaccaatgttctttttttagaatttcaggttgtggcattcactgagtatgcagctactatggtttttgtatgggacgtataaatacttgattatatacgacagattttaatgtctttaaagacttcctgctgtattaacatattgtaatggagtcttttaaatactaggttgaatttaattgaagtcacacacatcttgaagtggtaactgcatagtaaatactaccaagagtttttttcacgtgggagtatcctaaaactctgccatgggtgtaaatgttttacattaatttcataattggacagaccctgcatttagcgaaaa

SEQ ID NO: 2594 - DNA, 26 bp, Homo sapiens
ggtcagcctagcactctgacctagca

SEQ ID NO: 2595 - DNA, 112 bp, Homo sapiens
gcttgtcctcctttctgttacggtccagggcaaggtctttgaaaggtgtgagttggccagaactctgaaaagattgggaatggatggctacaggggaatcagcctagcaaac

SEQ ID NO: 2596 - DNA, 51 bp, Homo sapiens
aatgggagagtggttacaacacacgagctacaaactacaatgctggagaca

SEQ ID NO: 2597 - DNA, 66 bp, Homo sapiens
ttcagatcaatagccgctactggtgtaatgatggcaaaaccccaggagcagttaatgcctgtcatt

SEQ ID NO: 2598 - DNA, 72 bp, Homo sapiens
ctgcaagataacatcgctgatgctgtagcttgtgcaaagagggttgtccgtgatccacaaggcattagagca

SEQ ID NO: 2599 - DNA, 55 bp, Homo sapiens
ggtggcatggagaaatcgttgtcaaaacagagatgtccgtcagtatgttcaaggt

SEQ ID NO: 2600 - DNA, 221 bp, Homo sapiens
gtgaaaggtcacactaccattatttccccttcaaacaaataatatttttacagaagcaggagcaaaatatggcctttcttctaagagatataatgttcactaatgtggttattttacattaagcctacaacatttttcagtttgcaaatagaactaatactggtgaaaatttacctaaaaccttggttatcaaatacatctccagtacattccgttctttt

SEQ ID NO: 2601 - DNA, 367 bp, Homo sapiens
ccggccacattcagttcttatcaaagaaataacccagacttaatcttgaatgatacgattatgcccaatattaagtaaaaaatataagaaaaggttatcttaaatagatcttaggcaaaataccagctgatgaaggcatctgatgccttcatctgttcagtcatctccaaaaacagtaaaaataaccactttttgttgggcaatatgaaatttttaaaggagtagaataccaaatgatagaaacagactgcctgaattgagaattttgatttcttaaagtgtgtttctttctaaattgctgttccttaatttgattaatttaattcatgtattatgattaaatctgaggcagatgagcttacaagta

SEQ ID NO: 2602 - DNA, 860 bp, Homo sapiens
agagccgcccaaactgccgttgatgtgtggaggggaagcaagatgggtaagggctcaggaagttgctccaagaacagtagctgatgaagctgcccagaagtgccttggctccagccctgtaccccttggtactgcctctgaacactctggtttccccacccaactgcggctaagtctctttttcccttggatcagccaagcgaaacttggagctttgacaaggaactttcctaagaaaccgctgataaccaggacaaaacacaaccaagggtacacgcaggcatgcacgggtttcctgcccagcgacggcttaagccagcccccgactggcctggccacactgctctccagtagcacagatgtctgctcctcctcttgaacttgggtgggaaaccccacccaaaagccccctttgttacttaggcaattccccttccctgactcccgagggctagggctagagcagacccgggtaagtaaaggcagacccagggctcctctagcctcatacccgtgccctcacagagccatgccccggcacctctgccctgtgtctttcatacctctacatgtctgcttgagatatttcctcagcctgaaagtttccccaaccatctgccagagaactcctatgcatcccttagaaccctgctcagacaccattacttttgtgaacgcttctgccacatcttgtcttccccaaaattgatcactccgccttctcctgggctcccgtagcacactataacatctgctggagtgttgctgttgcaccatactttcttgtacatttgtgtctcccttcccaactagactgtaagtgccttgcggtcagggactgaatcttgcccgtttatgta

SEQ ID NO: 2603 - DNA, 135 bp, Homo sapiens
cccaccccatgtctctgtccttgtcccagccaggccctgctccctctccagccttgacagcccctccccctgcctatgccaccctgggcccccgcccatctccagggggctctgcaggggccagttcctccacct

SEQ ID NO: 2604 - DNA, 81 bp, Homo sapiens
ggctgagctcgtctttgacctgctggtcatcatgttcctcatgctgctccgaaggttccgaagccgatactggtctccagg

SEQ ID NO: 2605 - DNA, 32 bp, Homo sapiens
gaactacaaaaccaattctgagtctccctctg

SEQ ID NO: 2606 - DNA, 41 bp, Homo sapiens
atgctatcgcgacagaacaattacaccgtcaacaacaagag

SEQ ID NO: 2607 - DNA, 38 bp, Homo sapiens
tctctgctggttactcacgatggccctcggtgacatcc

SEQ ID NO: 2608 - DNA, 34 bp, Homo sapiens
ctgggctgtttcaccaagtgccggaagccatgca

SEQ ID NO: 2609 - DNA, 46 bp, Homo sapiens
gagtgtggctgtgcctacatcttctatccgcggccccagaacgtgg

SEQ ID NO: 2610 - DNA, 45 bp, Homo sapiens
gatgttcctgttgagaacctttacccttcaaagtacacacagcag

SEQ ID NO: 2611 - DNA, 34 bp, Homo sapiens
tggacagacttgggggcgattatggcgactgcac

SEQ ID NO: 2612 - DNA, 25 bp, Homo sapiens
tggagacctccatcagcatgaggaa

SEQ ID NO: 2613 - DNA, 28 bp, Homo sapiens
tgatggtggctttaacttgcggcctggc

SEQ ID NO: 2614 - DNA, 42 bp, Homo sapiens
gtctgtccctgatgctgcgcgcagagcagaatgacttcattc

SEQ ID NO: 2615 - DNA, 52 bp, Homo sapiens
ttactctcacttccaccacccgatgtatggaaactgctatactttcaatgac

SEQ ID NO: 2616 - DNA, 141 bp, Homo sapiens
tcggactgcttctaccagacatactcatcaggggtggatgcggtgagggagtggtaccgcttccactacatcaacatcctgtcgaggctgccagagactctgccatccctggaggaggacacgctgggcaacttcatcttc

SEQ ID NO: 2617 - DNA, 193 bp, Homo sapiens
tggaccgcatcacagagcagacgctctttgacctgtacaaatacagctccttcaccactctcgtggccggctcccgcagccgtcgcgacctgcgggggactctgccgcaccccttgcagcgcctgagggtcccgcccccgcctcacggggcccgtcgagcccgtagcgtggcctccagcttgcgggacaacaa

SEQ ID NO: 2618 - DNA, 381 bp, Homo sapiens
accgacactcgcctgcggggatcagggcgggatgacctgggtaccgcggtcacgccaaggccgaggccctcacccttcccctctttgggaaagggcagacaagttccgggttcccttctaggtccgggcgagggggagagcgccccacagacgacaggcgcctcctgcctctctccttcaataaacagtccacagtgtcccggctgggctcgccgtggcctccgccttcccggcggacacacctgtttacccttcaccgccggacggccaggaggcgccacgacgaccccagccccgcccaggcttctccgggatggaccggcctcccggggcacagatgaggaccctgaccccggaggggccagacactcgctccagggc

SEQ ID NO: 2619 - DNA, 194 bp, Homo sapiens
gaggccctgatcgagttccaccgctcctaccgagagctcttcgagttcttctgcaacaacaccaccatccacggcgccatccgcctggtgtgctcccagcacaaccgcatgaagacggccttctgggcagtgctgtggctctgcacctttggcatgatgtactggcaattcggcctgcttttcggagagtactt

SEQ ID NO: 2620 - DNA, 38 bp, Homo sapiens
ggaggagcaggaccctagacctctgcagcccataccag

SEQ ID NO: 2621 - DNA, 45 bp, Homo sapiens
ccggccagcgggcgggctccccagccaggccgctgcacctgtcag

SEQ ID NO: 2622 - DNA, 77 bp, Homo sapiens
caagggaacctggtttggaatcctggttgacaccggctttcactttaagaagtcgcaagagactgccgcaagagagg

SEQ ID NO: 2623 - DNA, 45 bp, Homo sapiens
gagagtcaacatatgtgattgttccataataaacttctggtgtga

SEQ ID NO: 2624 - DNA, 103 bp, Homo sapiens
gcagcattacagaaatacataggcttatatacaatgcttctttcctgtatattctcttgtctggctgcacccctttttcccgcccccagattgataagtaatg

SEQ ID NO: 2625 - DNA, 29 bp, Homo sapiens
cagagatggagagctaaagtccaagagag

SEQ ID NO: 2626 - DNA, 46 bp, Homo sapiens
tcccttcattaacaggagaaatgcaaataccttcatatcccctcag

SEQ ID NO: 2627 - DNA, 945 bp, Homo sapiens
tgggatttaagctacaggcgacatatttagaagccataaaatctcatttggaaattttaaattggcaccacgtcaactgcacagatggaaaacgaggagtaatgacaaatggtaaagcacagagctggacgccaagtcagctgggagaccacaggcgccacgttaagctgagtgctgttttggtttttttgtgtttttctttcttgtttttttttttgagacagtgtctcactctgtcgcccaggctagagtgcagtggtgtgatctcggctcgccgcaacctccacctcccaggttcaggcaattctcatgcctcagcctcctgagtagctgggattacaggcccatgacatcatgcctggctaatttttgtatttttagtagagatggggtttcaccatgttgtccaggctggtctcgaactcctggcctcaagtgatccacccaccacagcctcccaaagtgccgggattacaggcatgagccaccacacccagccagctgattgctgttgaatagctggatttataaagactgagcataggaggaaatggcacatcactctcatttttaatttattcattatttttatagtgtttaaactgttcatgtatcggcaatctagttatgcttcataaatcctcaggacagagaatttctcctcaaaaggaatttaaaatctaccaagtagaaatacagaaattaagaaaggcaaagtgatcgtccaaactcaaaaccaacaaagcctatatgacaagtctctaagacacatggattgattactgatttcatttgatcaggaagttaatgaaatctactttatactctcctttaatttttgccaatctccgtttatatgagttgcataagttaaggcactttcaaatatatttgtgtcaaggaatattcacggaaatatttccagctatgtgtcgctaaaactgc

SEQ ID NO: 2628 - DNA, 62 bp, Homo sapiens
agaagaaaacttcggctttgatatcgtttcagttctctctctgaactggcatcgtgcccagg

SEQ ID NO: 2629 - DNA, 35 bp, Homo sapiens
cctggccgccttagcggtagtaactttgtgttatg

SEQ ID NO: 2630 - DNA, 35 bp, Homo sapiens
ctgctgctacacaagaccctgagactgacctgcag

SEQ ID NO: 2631 - DNA, 29 bp, Homo sapiens
cctcacagccttccactaacatcccgtag

SEQ ID NO: 2632 - DNA, 41 bp, Homo sapiens
atctccaactccctatgtaaatcaacaacctgcataataaa

SEQ ID NO: 2633 - DNA, 70 bp, Homo sapiens
agttaaaggctgtctccaagtccctgaactcagcagaaatagaccatgtgaaaactccatgcttggttag

SEQ ID NO: 2634 - DNA, 243 bp, Homo sapiens
tatcgtgcattcatactctgtaagcccatctgtaacacacctagatcaaggctttaagagactcactgtgatgcctctatgaaagagaggcattcctagagaaagattgttccaatttgtcatttaatatcaagtttgtatactgcacatgacttacacacaacatagttcctgctcttttaaggttacctaagggttgaaactctaccttctttcataagcacatgtccgtctctgactcag

SEQ ID NO: 2635 - DNA, 47 bp, Homo sapiens
aagaaaatcgtgaatcagaaggaaagactccaaaggtggaactctga

SEQ ID NO: 2636 - DNA, 103 bp, Homo sapiens
aggagtctcaactgccagctttggcaatttaccagactctagatgacgagtgggatacactgcccacagcagaagtttccgtagagcatgtgcaaaacttttg

SEQ ID NO: 2637 - DNA, 101 bp, Homo sapiens
gatttcaatttcatggtgcagaccataaattcaatcagtgtgagctgcaacaattacaaggtatctctttatccctggacgtcacctcagatagaactttt

SEQ ID NO: 2638 - DNA, 72 bp, Homo sapiens
atgaacaaggcctccccagagtatgaagagaacatgcacagataccagaaggcagccaagctcttccagggg

SEQ ID NO: 2639 - DNA, 34 bp, Homo sapiens
ggttattcaacagcgtaattcagattcatctcct

SEQ ID NO: 2640 - DNA, 70 bp, Homo sapiens
acaactgaatttagaggacgaagacattgaaagcattgatgccaccaaattgagccgtttcattgagatc

SEQ ID NO: 2641 - DNA, 100 bp, Homo sapiens
cacatcaaatgttaaacgagtcctgattatgatgataatgatgatgattttggtggttgcaatagcaaagccttaagtatgaaggagacttgccagctgg

SEQ ID NO: 2642 - DNA, 110 bp, Homo sapiens
ccatactccatagcatggtgcaaaaattcccaggcgtgtcatttgggatcagcactgattctgaggttctgacacactacaacatcactgggaacaccatctgcctcttt

SEQ ID NO: 2643 - DNA, 26 bp, Homo sapiens
cactgaggtggctgtcataggcttct

SEQ ID NO: 2644 - DNA, 45 bp, Homo sapiens
gtgagctggctgcagaagttgctgcagaagttgagaaatcctcag

SEQ ID NO: 2645 - DNA, 30 bp, Homo sapiens
ggttcatgttcctcttatttctcctcacgt

SEQ ID NO: 2646 - DNA, 273 bp, Homo sapiens
ttctaccttgtgttgcctggcaaaatcttacttacccagaactctgctccggcatcctccgcaggaagaacactttcattgaaccctagcattgtccctaatacccttaatatgtattgtcatagcaccctatgaatttttctatatcactttccatcttatatttaaataatctttttacttgcccatctctcccactgataatctaagctggcagaggctggatcagatcataattatctttctattcttagcgctaggatcaatgcctgg

SEQ ID NO: 2647 - DNA, 172 bp, Homo sapiens
ccttttctggagagtagtctagaccaagccaattgcagaaccacattctttggttcccaggagagccccattcccagcccctggtctcccgtgccgcagttctatattctgcttcaaatcagccttcaggtttcccacagcatggcccctgctgacacgagaacccaaagtt

SEQ ID NO: 2648 - DNA, 171 bp, Homo sapiens
tcttgccggaggtagcagtggaagctactactccagcagcagtgggggtgtcggcctaggtggtgggctcagtgtggggggctctggcttcagtgcaagcagtggccgagggctgggggtgggctttggcagtggcgggggtagcagctccagcgtcaaatttgtctccac

SEQ ID NO: 2649 - DNA, 35 bp, Homo sapiens
actcagtggagaaggagttggaccagtcaacatct

SEQ ID NO: 2650 - DNA, 172 bp, Homo sapiens
aggtcaatccctcttcattggaaaatccctctggagagttctcccttcctttaacttaagcagcttttgggtgtacagactcctggcttatggaatgaactcgaatcatgaggatgggagttagccacatagactaatgctgtctttttgggagctgttaacccttaattca

SEQ ID NO: 2651 - DNA, 290 bp, Homo sapiens
caagatggccttcagctgataaagcgaagctgctctactgtggggtgtacaacacacatacatgagatcagtgacttgtgcgtgataatgacacatcatcaacactatttcagtctgactcatggccatatagctgacctcaactcacttttctggtctcttttcccccaccggtgttcctgggcactggctgtcctccaagcacctgagcaactcagcaatcttcttgacacttgtgccttttctgcttttgctcacgtcctttgctcaacctcaatatccatgtcatg

SEQ ID NO: 2652 - DNA, 37 bp, Homo sapiens
tgcgccaatctgcagaacgccattgcggatgccgagc

SEQ ID NO: 2653 - DNA, 119 bp, Homo sapiens
cttttgctaaacacacgcagctagatccagtaccagtgtttcagtgtcctgccacccacgatgtactggtttctctctgggattcatgatagtttggtttgtctgacccagaaactcag

SEQ ID NO: 2654 - DNA, 101 bp, Homo sapiens
agctggccggcatggcgatgacctccgcaacaccaagcatgagatctctgagatgaaccggatgatccagaggctgagagccgagattgacaatgtcaaga

SEQ ID NO: 2655 - DNA, 156 bp, Homo sapiens
cagatgcagacgcatgtctctgacacctcagtggtcctctccatggacaacaaccgcaacctggacctggatagcatcatcgctgaggtcaaggcccagtatgaggagattgccaaccgcagccggacagaagccgagtcctggtatcagaccaag

SEQ ID NO: 2656 - DNA, 32 bp, Homo sapiens
cagaaccagatgaccgactccaaatctccctg

SEQ ID NO: 2657 - DNA, 35 bp, Homo sapiens
ggccaaggttgatgcactgatggatgagattaact

SEQ ID NO: 2658 - DNA, 57 bp, Homo sapiens
gcagcctgcagctatgctctctaagcgtggagctcacttgagtagggtgacggtgtg

SEQ ID NO: 2659 - DNA, 34 bp, Homo sapiens
tgaaatcaacaagcgtaccactgctgagaatgag

SEQ ID NO: 2660 - DNA, 26 bp, Homo sapiens
aaaagaacactagagaaattgactag

SEQ ID NO: 2661 - DNA, 36 bp, Homo sapiens
gtggacacgttctgaattagactggcagctgggaag

SEQ ID NO: 2662 - DNA, 62 bp, Homo sapiens
caacctgcaaatcgaccccagcatccagagggtgaggaccgaggagcgcgagcagatcaaga

SEQ ID NO: 2663 - DNA, 47 bp, Homo sapiens
gaggtggtgccggtagtggatttggtttcggcggtggagctggtggt

SEQ ID NO: 2664 - DNA, 32 bp, Homo sapiens
ggcagcttcaggaaccggtttggtgctggtgc

SEQ ID NO: 2665 - DNA, 32 bp, Homo sapiens
gggctccaagaggatatccatcagcactagtg

SEQ ID NO: 2666 - DNA, 44 bp, Homo sapiens
tgtggagtgggtggctatggcagccggagcctctacaacctggg

SEQ ID NO: 2667 - DNA, 29 bp, Homo sapiens
tggtggcttcggcagggtcagccttgcgg

SEQ ID NO: 2668 - DNA, 80 bp, Homo sapiens
tcaagtgtgtccttccggagcgggggcagtcgtagcttcagcaccgcctctgccatcaccccgtctgtctcccgcaccag

SEQ ID NO: 2669 - DNA, 137 bp, Homo sapiens
acagctcgacagctctctcgcccagcccagttctggaagggataaaaagggggcatcaccgttcctgggtaacagagccaccttctgcgtcctgctgagctctgttctctccagcacctcccaacccactagtgcct

SEQ ID NO: 2670 - DNA, 102 bp, Homo sapiens
cccagcctctatggtgaagacatacttgctagcagcgtcaccaacttgctgccaagagatcagtgctgcaaggcaaggttatttctaactgagcagagcctg

SEQ ID NO: 2671 - DNA, 41 bp, Homo sapiens
ggctcagccctagccctcagcccacctggggagtttactac

SEQ ID NO: 2672 - DNA, 27 bp, Homo sapiens
ccgctatgcagggtagcactgggaaca

SEQ ID NO: 2673 - DNA, 32 bp, Homo sapiens
cctcccagcctacccctcctgcgctgccccag

SEQ ID NO: 2674 - DNA, 25 bp, Homo sapiens
tctgagtcctctgacgtcctgccca

SEQ ID NO: 2675 - DNA, 27 bp, Homo sapiens
agctcctccagggccgtggttgtgaag

SEQ ID NO: 2676 - DNA, 48 bp, Homo sapiens
ggatgcagaacatgagtattcatacgaagaccaccagcggctatgcag

SEQ ID NO: 2677 - DNA, 61 bp, Homo sapiens
tgggacttggggtcctgttgttctgggccaagaagggctaggagttggtcctgacacccca

SEQ ID NO: 2678 - DNA, 36 bp, Homo sapiens
gtgggtacctctgaccggacctgcttccctatccct

SEQ ID NO: 2679 - DNA, 38 bp, Homo sapiens
cgccattgcagatgccgagcagcgtggagagctggcca

SEQ ID NO: 2680 - DNA, 38 bp, Homo sapiens
cggggatgacctgcggcgcacaaagactgagatctctg

SEQ ID NO: 2681 - DNA, 28 bp, Homo sapiens
gtaccagatcaagtatgaggagctgcag

SEQ ID NO: 2682 - DNA, 32 bp, Homo sapiens
acagtacgaggatattgccaaccgcagccggg

SEQ ID NO: 2683 - DNA, 38 bp, Homo sapiens
tctcgcctggaagggctgaccgacgagatcaacttcct

SEQ ID NO: 2684 - DNA, 220 bp, Homo sapiens
ttggacagaactcttgacatcggtgttgggacatggttcagaaaacagagcagtagaactggagatctggctctagaaggctccctagagaaggaggtggaagagggtgtgttgcaggaagcagaggtgaaggtgtgtgggctgagaatgcacatgtgatgggcagaggctgggctggaagatcaatccacaaagtgggcaactagaaagtcctgtgacc

SEQ ID NO: 2685 - DNA, 37 bp, Homo sapiens
ataagcgtacagagatggagaacgaatttgtcctcat

SEQ ID NO: 2686 - DNA, 232 bp, Homo sapiens
ggtgaccacctgatgaggtttgctcggaacagtctgtgtttatgcccaggttcctagcacaattgttgatagtacccaccccctttcaatctcaactgtctggatttgaagaacaaattatgtgtcaatgttgacatggtaaacctgagacgggagagataggcagcctgtgggcctcacttttgtacttaacattctggcccctctttagtcttgacccttgacctctagc

SEQ ID NO: 2687 - DNA, 30 bp, Homo sapiens
cagaagacggctcgaagcaacatggacaac

SEQ ID NO: 2688 - DNA, 93 bp, Homo sapiens
ctggagaccttactgcttgaggagtgaattaagagaaaagactgcttgctttcctccagactttgagccctggcctgatgtagacctttttgc

SEQ ID NO: 2689 - DNA, 34 bp, Homo sapiens
gcggccccgaggattgggcccttcacgctgactg

SEQ ID NO: 2690 - DNA, 27 bp, Homo sapiens
agcaactttcgcggtggcctgggcggc

SEQ ID NO: 2691 - DNA, 31 bp, Homo sapiens
gatctccgcctggttcggcccgcctgcctcc

SEQ ID NO: 2692 - DNA, 80 bp, Homo sapiens
ggatctggctgtcatctgttggtcctctgagttcagtttcatccagtccccacatcacaccctgcagtatcttccagaga

SEQ ID NO: 2693 - DNA, 185 bp, Homo sapiens
taagtttgtctgtcctccaaggagggggcttctgggtctctctgtccttctgggtaggggtcctatgtgcctgtctttctgtgagcctgggtgtctctcctagagaaggatggggaagaaactgtacatctgtcctcccagtaggtggtcacccccttccctgggtcagggctatgtcacctgtc

SEQ ID NO: 2694 - DNA, 28 bp, Homo sapiens
aggaggtgctggcgagtttgaaatttgg

SEQ ID NO: 2695 - DNA, 48 bp, Homo sapiens
agcgcctgcatagacgctggccgcgctgctgaccggccgggcgccgta

SEQ ID NO: 2696 - DNA, 75 bp, Homo sapiens
ctggggtcccttcttctccaagtgctcccggattttgctctccagcctccggttctcggtctccaggctcctcac

SEQ ID NO: 2697 - DNA, 74 bp, Homo sapiens
taggggttgggtggttatggaatgacggaaagaggcaaaggagtgtataattggagggtcagacaaggctggga

SEQ ID NO: 2698 - DNA, 115 bp, Homo sapiens
cctctgtaaagctctcaaccctgtccccttccccctctctcctgggaaagagccctcccatgcctagctgctgctcttagggaccctgtggctaggtgcgcggatggaaatccag

SEQ ID NO: 2699 - DNA, 158 bp, Homo sapiens
tggtacagcggcctttcatcagaggatcatcattgagactgagttgactggcagatatgtgcgatggatattacattaggtacaatgtgtatttttgattttcatgagttttctacattaaggtaaattccttagagtgtgatagcagcctcagttta

SEQ ID NO: 2700 - DNA, 546 bp, Homo sapiens
gaaatcaaaagatatctctggcctgcaatattttactgatgtgaacataggattttccactaaataatttgtctacttctagcattcacttacaaagagttcttaaaaacacctataataggtacttagatttcacaacttacttagatatttgtcattattcccattcctggtgtttttactggttcatatacaatggtattctattagataagaagctgctatgtgatctcagcactcactccttggttgtcaagaaatggtggataactcacaggattaaaaatgaatgaatataaaattttctgaaatagatatttaaaaaatcattttagcttgaagccaatatgtctggatcataggttttgagttcataatccagtaataacagctttcagctttctatgagtatatacaattctatacaatgataaatactctgcatataatttataaaaataacttctgttttacctagttaacaataaaacctatgtgtggagccaaatgttatgcagacaaaggtctgctcatcccataccagtg

SEQ ID NO: 2701 - DNA, 252 bp, Homo sapiens
accttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttc

SEQ ID NO: 2702 - DNA, 131 bp, Homo sapiens
gtgtcagttttcatagtatccatattttattactgtttattacttccatgaattttaaaatctgagggaaatgttttgtaaacatttattttttttaaagaaaagatgaaaggcaggcctatttcatcaca

SEQ ID NO: 2703 - DNA, 41 bp, Homo sapiens
atgaatgtctacgtgttgctaacgaagtcactcttaattaa

SEQ ID NO: 2704 - DNA, 71 bp, Homo sapiens
agatcctggggccattatcctactccaagatcaagcatttgcgtttggatggcaatcgcatctcagaaacc

SEQ ID NO: 2705 - DNA, 403 bp, Homo sapiens
cctgacagagtctgtgggcccacttcccaaatctctggaggatctgcagcttactcataacaagatcacaaagctgggctcttttgaaggattggtaaacctgaccttcatccatctccagcacaatcggctgaaagaggatgctgtttcagctgcttttaaaggtcttaaatcactcgaataccttgacttgagcttcaatcagatagccagactgccttctggtctccctgtctctcttctaactctctacttagacaacaataagatcagcaacatccctgatgagtatttcaagcgttttaatgcattgcagtatctgcgtttatctcacaacgaactggctgatagtggaatacctggaaattctttcaatgtgtcatccctggttgagctggatctg

SEQ ID NO: 2706 - DNA, 201 bp, Homo sapiens
tgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattg

SEQ ID NO: 2707 - DNA, 38 bp, Homo sapiens
gtgcatctgctttaagaattaacgaaagcagtgtcaag

SEQ ID NO: 2708 - DNA, 46 bp, Homo sapiens
tggcagccagttccgtcctgacagagttcacagcatatattggtgg

SEQ ID NO: 2709 - DNA, 251 bp, Homo sapiens
gccacagatgtaaagaggcttgtaagaaaaatgttctcacagtgagcttccttatttgaagcaggactcaattcttggttaaaagctatggtatttgagctagttaaacacatatctctctcccattccatagggaatgagctgggctgtcctttctccccacgttcacctgcacttcgttagagagcagtgttcacatgccacaccacaagatccccacaatgacataactccattcagagactggcgtg

SEQ ID NO: 2710 - DNA, 203 bp, Homo sapiens
caacttccatatggaggtgtcaaggaggatttagatctagaattttggagctcaagggaaagggttgagctgtagacataaattctagagatgccggaatatagattgtgatccttctttatcagcacagaaatgacttgactttgtccaaactaagcaatcatactgtacatgttagcaacacattttacagggccaatttg

SEQ ID NO: 2711 - DNA, 275 bp, Homo sapiens
actgtgagggctgaatgaatgcttccaggccatcaggaacaagcatagaaacacaaatcaattttaaaatacactcaaaaatgtcaaaataatccaacttttttgtcttgatcagatatatctactagcacatattacttcattttttcagccaatatttattaataacctactgtgtgcttgacagtgttctagtggcagagacacagcagtgcataatgccttgccctctgaagcagatgttgcagcaggaggagacattccaggacatgaca

SEQ ID NO: 2712 - DNA, 234 bp, Homo sapiens
ggtgttgctactgccattgttattacaggcacacagttcgagctataatcatttcaagggaaattcttatgtgtcagttctggatcgaggtctgagattctgcatttcaaacaaacttccaggaatgctgctgcttcttggtccacacttggagaaataagtcagcagagagtcctctcgtttcctattgtaccatgtctgtcttttgtctcctgcttattggcctctgtaagg

SEQ ID NO: 2713 - DNA, 267 bp, Homo sapiens
agccttcaatgatgcacactccatgttatagccttgaatgatataccctttatgctgcagcctttctcttatggggaaaagcctgcagatatcctgctgcttaactgacaagtgtggtgagaaataagtagaaatctaaagaggggaagaccattttggacacttatctgcaaggcagatccaacacacttttccagtagtcaagctacttctaattttgttcagtatcaaaatgagaaacaggcctgattctccagcactcttgtc

SEQ ID NO: 2714 - DNA, 45 bp, Homo sapiens
atgagtgcagtggaacatgaaaaacttgaggagataacagttgag

SEQ ID NO: 2715 - DNA, 198 bp, Homo sapiens
ttcatgtaatcaggctgaacatttctacaattactagatgtattagacgtaagtattttctttagttaaaccacccatgttagaaatgttttctgtagaatttataaacaactatcaatgcagacaatttaataagcctggggatgatttacttacagtaaacatttatcaaattgtacatttgtgctatcaacaatt

SEQ ID NO: 2716 - DNA, 119 bp, Homo sapiens
cctctccctatcttacatttgagtatggtaacttatgtcatctatgttgaatgtaagcttataaagcacaaagcatacatttcctgactggtctagagaactgatgtttcaatttaccc

SEQ ID NO: 2717 - DNA, 34 bp, Homo sapiens
tacaggctatgtaaaatttttactaatgtcatta

SEQ ID NO: 2718 - DNA, 96 bp, Homo sapiens
cagttagctcatttgagataaagtcaaatgccaaacactagctctgtattaatccccatcattactggtaaagcctcatttgaatgtgtgaattca

SEQ ID NO: 2719 - DNA, 33 bp, Homo sapiens
tctgttgatgttaactgagctactagagatatt

SEQ ID NO: 2720 - DNA, 25 bp, Homo sapiens
cataaagccaaatttccagtttaag

SEQ ID NO: 2721 - DNA, 29 bp, Homo sapiens
ctgcaatgtggatgttttacccacatgac

SEQ ID NO: 2722 - DNA, 26 bp, Homo sapiens
tataacctggcaaaatcttgttaatg

SEQ ID NO: 2723 - DNA, 31 bp, Homo sapiens
gtgcgctctgccattcaactcggaaactata

SEQ ID NO: 2724 - DNA, 124 bp, Homo sapiens
tctctgtagttggatcaagtgacttctgcccacctggacacaacaccaaaaaggcttcttattcgggtgtgagtcttttcagcaacccggtccagtactgggagatacagccatccaccttcag

SEQ ID NO: 2725 - DNA, 213 bp, Homo sapiens
gcttctttggtctagctcctgattctttttgacatggcctcatcatttttctttatttcctctaaaaaaaaaatgagatacgtttgcagaatgtgcaggtttgttatataggtatacgtgtgccatggtggtttgctggccctactgacccatcctctaagttcgcccgctcaccccctaccccctgttgtgtgttttgttaccctctctgtg

SEQ ID NO: 2726 - DNA, 27 bp, Homo sapiens
ccactgcttatgtgaggaatatccaaa

SEQ ID NO: 2727 - DNA, 103 bp, Homo sapiens
ctgctgttgacaatggctctctggccaacacgcctcatctgagggagcttcacttggacaacaacaagcttaccagagtacctggtgggctggcagagcataa

SEQ ID NO: 2728 - DNA, 83 bp, Homo sapiens
ccttcccttacggaattacatcttgatggcaacaaaatcagcagagttgatgcagctagcctgaaaggactgaataatttggc

SEQ ID NO: 2729 - DNA, 123 bp, Homo sapiens
cctggagcatttacacctttggtgaagttggaacgactttatctgtccaagaatcagctgaaggaattgccagaaaaaatgcccaaaactcttcaggagctgcgtgcccatgagaatgagatc

SEQ ID NO: 2730 - DNA, 102 bp, Homo sapiens
gacaaagtgccaaaggatcttccccctgacacaactctgctagacctgcaaaacaacaaaataaccgaaatcaaagatggagactttaagaacctgaagaac

SEQ ID NO: 2731 - DNA, 114 bp, Homo sapiens
gcgcccggcctcaatatgtcttctaatcttaaagataaagaagaggaaccagaattgaaattcacataacagtcttataaaaaaatgttattataggagcatgtttaaatatga

SEQ ID NO: 2732 - DNA, 521 bp, Homo sapiens
atgcatggcttggttcttgaattaatgcttggatgaatattctacaatattcttgactctagcaagctgcaaagagaagggaacatgcctgattgagaaacaaaagtgatttctcagtgcatccttgctccttccctttaaggacaactgtaaaaccaggaagcttagaaattccttgagtttgactggaaagagaatagaattaaagagaagaatcatctatgtatgaagcctggtctaactgataacgcagtcagattgccatttttaagatggaaaaaggggaacatgcttgccttgagcagaaaagtttttggtggggctggagctcctaaatattattttggtcatttgcccaaaaactgaagtacaccaccaatgtcccaattatgaagttgaatacagaattataaaaaaaaattgttgaaagtcaataagaataaatcttagaatttggactcctgccacatggcagaaaaaaagcatgatgttttaagacaacctggcctttgtccaacatg

SEQ ID NO: 2733 - DNA, 278 bp, Homo sapiens
tctgcaggataatttgatgcctctggaaaaatgcatggactgttttagtccctaattctaatttatcacagtagtattaacacgtgcttttttttttttttaagaggatgagggattgagacagtaaacatgaattcctcatagatattggccaagttgtttcattgaacttgttgcaacttaccttgtaattggaaccacaattttatgagacccatatcttgtcttcttttatctatcatgttaagaaataaaccagttccctcttaattatagca

SEQ ID NO: 2734 - DNA, 324 bp, Homo sapiens
tcctattaatcgtgtgaggtacctgggtcatagtagcagcttcatgcagtgttaaaattatatgatgattatatgcagtaacagatgaagaaaaaaagaaagaaagcaggagaaatgcaccacctcattcattgtaaatgcagtatagttgattttttaatttgttttatgtcctctagtgatctaagcatgaagcttgaattattataataaagaaaataaatgcaatgcagttggggatggcaaatgttaatgcttatctgtatcaaagactaacactgtcttcaggattatccttggtggattatccttggcagacactta

SEQ ID NO: 2735 - DNA, 490 bp, Homo sapiens
tgtagtcttaggaagcagcaagttcactgacttgggatctttatgacagttttgttgttgccattgatattgttttgtttattttttgttttcagatgagaaagttttctacatgttatcttttttctaggagctcaaagtgtacatcattcctttattatagctaggtttactgactcatatactaaggaagtagctaaaattataaaaataatttgtttttaaaaccatatttaactaagggaactaagtaagttccaatgagcagtggtctcatgcaaggtattttcaatattttaaaatttacagatgaatatttaaatatattataaaagttttaatcagctatctctaagaaaatacatttcttaaagggaaatgaaattcacttgactttaaataaaacaaatgaactcatttcatgtttttaactattatctaactcttccttactttatgatgctggcaagctgttgagagccttgacatc

SEQ ID NO: 2736 - DNA, 486 bp, Homo sapiens
tgattccgccatgtgtacttccttctggaagaaattccatactatgatcaggcacttctttcagaagtcctatatttactcagaacatgctttctagcagtagtttgcagaagaaaaatgcaacttctacaattggaataaactgcctataggaacccagaaaaaatataaagtatattcagtagtaacgactgaaaaacacttgaaatagcttcttcaacacatatattgtatagctatttaaaacccaaatacaaatgttatatgaagactttcaaaaggccgcaggataattccaatggatctatttgttcagtcattcagaagctatatcgggaacccatcatggatgagctctgctctaggcatggggagaaaggatgaggaagacaaatatggccctagttcttgtggatcttatgttctagtggtggtgactattactttttgaattgtgtatttgccacaggggagattggattactc

SEQ ID NO: 2737 - DNA, 28 bp, Homo sapiens
ccagaaagattgaagctcagtggatggg

SEQ ID NO: 2738 - DNA, 172 bp, Homo sapiens
ttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttg

SEQ ID NO: 2739 - DNA, 25 bp, Homo sapiens
atcatcctccttctgcttgcacaag

SEQ ID NO: 2740 - DNA, 144 bp, Homo sapiens
ggagtacatcgtctagtgagggacagaccaagcacgcaaaacaaattgcaatataatgtgataagttctttaaaagaggtaagagcaacgtgctttgggagcagagaagagggagaaagcagcatcttgcctggatgagccagg

SEQ ID NO: 2741 - DNA, 68 bp, Homo sapiens
gataatgactcaaaacagctgtaagattctacttacgaacgtacagctttaatatggattcgtctaag

SEQ ID NO: 2742 - DNA, 39 bp, Homo sapiens
cttctctagagaatctaggcaaaaattcccagaagatac

SEQ ID NO: 2743 - DNA, 155 bp, Homo sapiens
atctaatgtgggtgtcagccggattgtgttcattgagggaaaccttattttttaactgtgctatggagtagaagcaggaggttttcaacctagtcacagagcagcacctaccccctcctcctttccacacctgcaaactcttttacttgggctga

SEQ ID NO: 2744 - DNA, 140 bp, Homo sapiens
cagaggctgcggtttgactttttaatttttcttttgttatttgtatttgctagtctctgatttcctcaaaacgaagtggaatttactactgttgtcagtatcggtgttttgaattggtgcctgcctatagagatatattc

SEQ ID NO: 2745 - DNA, 598 bp, Homo sapiens
gctgccgtgcactttgtcggatataaaataaaccacgggcccgccatggcgttagcccttccttttgcagttgcgtctgggaaggggccccggactccctcgagagaatgtgctagagacagcccctgtcttcttggcgtggtttatatgtccgggatctggatcagattctgggggctcagaaacgtcggttgcattgagctactgggggtaggagttccaacatttatgtccagagcaacttccagcaaggctggtctgggtctctgcccaccaggcggggaggtgttcaaagacatctccctcagtgcggatttatatatatatttttccttcactgtgtcaagtggaaacaaaaacaaaatctttcaaaaaaaaaatcgggacaagtgaacacattaacatgattctgtttgtgcagattaaaaactttatagggacttgcattatcggttctcaataaattactgagcagctttgtttggggagggaagtccctaccatccttgtttagtctatattaagaaaatctgtgtctttttaatattcttgtgatgttttcagagccgctgtaggtctcttcttgcatgtccacagt

SEQ ID NO: 2746 - DNA, 53 bp, Homo sapiens
ttggttagcggcttggaagccaagccggacaggtcccgcagcgcgtccccgta

SEQ ID NO: 2747 - DNA, 115 bp, Homo sapiens
ggactcgggctctgaactcaacagccgctcctccacgctctcctccagctccatgtccttgtcgcccaaactctgcgcggagaaagaggcggccaccagcgaactgcagagcatc

SEQ ID NO: 2748 - DNA, 29 bp, Homo sapiens
ggcccctggacggcaaagtcgccgccctg

SEQ ID NO: 2749 - DNA, 93 bp, Homo sapiens
ccttcctcaatctgaacaccatgcgcccgcggctgcgctacagcccctactccatcccggtgccggtcccggacggcagcagtctgctcacca

SEQ ID NO: 2750 - DNA, 33 bp, Homo sapiens
ccttacccctacacgtacatggccgcagcggcg

SEQ ID NO: 2751 - DNA, 169 bp, Homo sapiens
gcctggcgggccaacagttcttcaacgggcacccgctcttcctgcaccccagccagtttgccatggggggcgccttctccagcatggcggccgctggcatgggtcccctcctggccacggtttctggggcctccaccggtgtctcgggcctggattccacggccatggc

SEQ ID NO: 2752 - DNA, 257 bp, Homo sapiens
gagccctgccgtgacaagggcagccccgcggtcaaggctcaccttttcgctgctgagcggccccgggacagcgggcggctggacaaagcgtcgcccgactcacgccatagccccgccaccatctcgtccagcactcgcggcctgggcgcggaggagcgcaggagcccggttcgcgagggcacagcgccggccaaggtggaagaggcgcgcgcgctcccgggcaaggaggccttcgcgccgctcacggtgcagacgga

SEQ ID NO: 2753 - DNA, 94 bp, Homo sapiens
aatgggacctctgatgagtcctccagtgaacaagcagctttcaactgcttcgcccaggcttcttctccagccgcctccactgtagggacatcga

SEQ ID NO: 2754 - DNA, 45 bp, Homo sapiens
tgcaaaaggtttccgggacactggaaatggccgaagagaaaaaag

SEQ ID NO: 2755 - DNA, 86 bp, Homo sapiens
gacatcttgaaactcccttatagtacatttcggacatacttgttccccgaaactgaattcatcgctgtgactgcataccagaatga

SEQ ID NO: 2756 - DNA, 222 bp, Homo sapiens
ctagggttcaaggtatgaatgatccttagatggtgagggtggggggggccctttggcaactgaggagcaatttggattctccagaagataacatctgtggagcgaaacgtacccagggggtactccaaggaggtgggctcggtacaagcgtggtaccctgcggtggggaagatttcagcctggcaggggtcctaagatcccgtttgttctgctaaatccttg

SEQ ID NO: 2757 - DNA, 43 bp, Homo sapiens
ctttggccttcccaagtgatcacgctacgtggcaggggaatta

SEQ ID NO: 2758 - DNA, 348 bp, Homo sapiens
ccaaataatggaaggcctggcgttctaaaagaaatggggcaagaaaacttaccggcttgtgttctatagcaattccagctctttggtagattcctgacctgagagtgaagttaaaaaccattttttaagagctaaaatcaatttcaaggctatgtattcctaaaggatttgttttgttttaaaatatcatacttctgttttgaaaccagtgatattattttctcaggagagtttacgtttcggagccttgactctgttggttaaatggtgtgaatacatttttaaaaactcgttcttttactaaaaaaagaattgggcttaggtgggagtccggcttaccctaaatga

SEQ ID NO: 2759 - DNA, 179 bp, Homo sapiens
atgttctgggctggataaaaaagccaaatacattttattgatggacattatagctgctgatgactgtcgttataaatttcacaattctcggtggatggtggctggtaaggccgaccccgaaatgccaaagaggatgtacattcacccggacagccccgctactggggaacagtggatgt

SEQ ID NO: 2760 - DNA, 62 bp, Homo sapiens
aaagaactttgggatcagtttcacaagcggggcaccgagatggtcattaccaagtcgggaag

SEQ ID NO: 2761 - DNA, 34 bp, Homo sapiens
ggccgagaccggcatcccgttctcctccctgggg

SEQ ID NO: 2762 - DNA, 156 bp, Homo sapiens
atggcctaccatccgttcctacctcaccgggcgccggacttcgccatgagcgcggtgctgggtcaccagccgccgttcttccccgcgctgacgctgcctcccaacggcgcggcggcgctctcgctgccgggcgccctggccaagccgatcatggat

SEQ ID NO: 2763 - DNA, 39 bp, Homo sapiens
agcctctccatgagagatccggtcattcctgggacaagc

SEQ ID NO: 2764 - DNA, 46 bp, Homo sapiens
aagctgcaggggatttgggggatgtgggacctccaattcccagccc

SEQ ID NO: 2765 - DNA, 50 bp, Homo sapiens
cagctccaggtcgggctccagctccagccgcagcttaggcagcggaggtt

SEQ ID NO: 2766 - DNA, 43 bp, Homo sapiens
tttccaatttcaccggctccgtggatgaccgtgggacctgcca

SEQ ID NO: 2767 - DNA, 54 bp, Homo sapiens
cacctttcccgtggacagagtggaacgcttggaattcacagctcatgttctttc

SEQ ID NO: 2768 - DNA, 100 bp, Homo sapiens
gtgagggaatatgtccaattaattagtgtgtatgaaaagaaactgttaaacctaactgtccgaattgacatcatggagaaggataccatttcttacactg

SEQ ID NO: 2769 - DNA, 66 bp, Homo sapiens
tggaaaaactggtcatacagctgaaggagagttttggtggaagctcagaaattgttgaccagctgg

SEQ ID NO: 2770 - DNA, 87 bp, Homo sapiens
aatatgactctcttggtagagaagcttgagacactagacaaaaacaatgtccttgccattcgccgagaaatcgtggctctgaagacc

SEQ ID NO: 2771 - DNA, 39 bp, Homo sapiens
gtgaggcctctaaagatcaaaacacccctgtcgtccacc

SEQ ID NO: 2772 - DNA, 215 bp, Homo sapiens
atcagcaaaccgtctgtggttcagctcaactggagagggttttcttatctatatggtgcttggggtagggattactctccccagcatccaaacaaaggactgtattgggtggcgccattgaatacagatgggagactgttggagtattatagactgtacaacacactggatgatttgctattgtatataaatgctcgagagttgcggatcaccta

SEQ ID NO: 2773 - DNA, 29 bp, Homo sapiens
gtagtggtacagcagtttacaacaacaac

SEQ ID NO: 2774 - DNA, 307 bp, Homo sapiens
caccgggaatattgccagagttaacctgaccaccaacacgattgctgtgactcaaactctccctaatgctgcctataataaccgcttttcatatgctaatgttgcttggcaagatattgactttgctgtggatgagaatggattgtgggttatttattcaactgaagccagcactggtaacatggtgattagtaaactcaatgacaccacacttcaggtgctaaacacttggtataccaagcagtataaaccatctgcttctaacgccttcatggtatgtggggttctgtatgccacccgtactatg

SEQ ID NO: 2775 - DNA, 28 bp, Homo sapiens
taccttctgaattatgatctttctgtct

SEQ ID NO: 2776 - DNA, 277 bp, Homo sapiens
tgcaggggtgtctaaaagtgtgttcattttgcagcaatgtttaggtgcatagttctaccacactagagatctaggacatttgtcttgatttggtgagttctcttgggaatcatctgcctcttcaggcgcattttgcaataaagtctgtctagggtgggattgtcagaggtctaggggcactgtgggcctagtgaagcctactgtgaggaggcttcactagaagccttaaattaggaattaaggaacttaaaactcagtatggcgtctagggattctt

SEQ ID NO: 2777 - DNA, 285 bp, Homo sapiens
ttcttttctctcattgtccaccttactaaaagtcagtagaatcttctacctcataacttccttccaaaggcagctcagaagattagaaccagacttactaaccaattccaccccccaccaacccccttctactgcctactttaaaaaaattaatagttttctatggaactgatctaagattagaaaaattaattttctttaatttcattatgaacttttatttacatgactctaagactataagaaaatctgatggcagtgacaaagtgctagcatttattgtta

SEQ ID NO: 2778 - DNA, 173 bp, Homo sapiens
tctaggacgagctatagaaaagctattgagagtatctagttaatcagtgcagtagttggaaaccttgctggtgtatgtgatgtgcttctgtgcttttgaatgactttatcatctagtctttgtctatttttcctttgatgttcaagtcctagtctataggattggcagtttaa

SEQ ID NO: 2779 - DNA, 51 bp, Homo sapiens
tgcttgtaactaaaataattttgtaatgtatcaaatacatttaaaacatta

SEQ ID NO: 2780 - DNA, 123 bp, Homo sapiens
agcagatctataggaagattgaacctgaatattgccattatgcttgacatggtttccaaaaaatggtactccacatatttcagtgagggtaagtattttcctgttgtcaagaatagcattgta

SEQ ID NO: 2781 - DNA, 942 bp, Homo sapiens
cgcattgcccagttgttagattaagaaatagacagcatgagagggatgaggcaacccgtgctcagctgtcaaggctcagtcgctagcatttcccaacacaaagattctgaccttaaatgcaaccatttgaaacccctgtaggcctcaggtgaaactccagatgccacaatggagctctgctcccctaaagcctcaaaacaaaggcctaattctatgcctgtcttaattttctttcacttaagttagttccactgagaccccaggctgttaggggttattggtgtaaggtactttcatattttaaacagaggatatcggcatttgtttctttctctgaggacaagagaaaaaagccaggttccacagaggacacagagaaggtttgggtgtcctcctggggttctttttgccaactttccccacgttaaaggtgaacattggttctttcatttgctttggaagttttaatctctaacagtggacaaagttaccagtgccttaaactctgttacactttttggaagtgaaaactttgtagtatgataggttattttgatgtaaagatgttctggataccattatatgttccccctgtttcagaggctcagattgtaatatgtaaatggtatgtcattcgctactatgatttaatttgaaatatggtcttttggttatgaatactttgcagcacagctgagaggctgtctgttgtattcattgtggtcatagcacctaacaacattgtagcctcaatcgagtgagacagactagaagttcctagtgatggcttatgatagcaaatggcctcatgtcaaatatttagatgtaattttgtgtaagaaatacagactggatgtaccaccaactactacctgtaatgacaggcctgtccaacacatctcccttttccatgactgtggtagccagcatcggaaagaacgc

SEQ ID NO: 2782 - DNA, 106 bp, Homo sapiens
cttcacagtgttcatgattgcagtgtctggaatttgcatcctgctgaatgtcactgaattgtgttatttgctaattagatattgttctgggaagtcaaaaaagcca

SEQ ID NO: 2783 - DNA, 260 bp, Homo sapiens
gcagctgatcttcgtgtccacgccagcgctcctagtggccatgcacgtggcctaccggagacatgagaagaagaggaagttcatcaagggggagataaagagtgaatttaaggacatcgaggagatcaaaacccagaaggtccgcatcgaaggctccctgtggtggacctacacaagcagcatcttcttccgggtcatcttcgaagccgccttcatgtacgtcttctatgtcatgtacgacggcttctccatgcagcggc

SEQ ID NO: 2784 - DNA, 49 bp, Homo sapiens
gattggggcacgctgcagacgatcctggggggtgtgaacaaacactcca

SEQ ID NO: 2785 - DNA, 171 bp, Homo sapiens
atcctatgacaaactaagttggttctgtcttcacctgttttggtgaggttgtgtaagagttggtgtttgctcaggaagagatttaagcatgcttgcttacccagactcagagaagtctccctgttctgtcctagctagtgattcctgtgttgtgtgcattcgtcttttcca

SEQ ID NO: 2786 - DNA, 27 bp, Homo sapiens
attacttcaaattgagtaattcagaaa

SEQ ID NO: 2787 - DNA, 114 bp, Homo sapiens
atcgaagagttgtgaactgttatcccattgaaaagaccgagccttgtatgtatgttatggatacataaaatgcacgcaagccattatctctccatgggaagctaagttataaaa

SEQ ID NO: 2788 - DNA, 251 bp, Homo sapiens
atgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttgg

SEQ ID NO: 2789 - DNA, 36 bp, Homo sapiens
tctagaagacgattaagggaaggtcgttctcagtga

SEQ ID NO: 2790 - DNA, 36 bp, Homo sapiens
acacacccgtgaggaagttgcaagccaacaaaaaag

SEQ ID NO: 2791 - DNA, 359 bp, Homo sapiens
gtggctaactctgggaagatacttgtgttaaactttatatgacatttaataacccttcatcataaggcaatgttttttacaaaaagattgaaaaaatcatgtaagtcatttactctgcaaaaatggcacattaggtggggttccaaaatccataatgaaacaatgtgttttgcaactaagaaacattcattatgatatatggaaaacactgtctgtctacttgtcctttacgaaaaaatgtaaaactctgaggatcataaaatttaactactaaaaataatcttcgtgtttaagtgatacttatttaagactttacactgttctgtttaaccatggtctcctgtctgattttagccata

SEQ ID NO: 2792 - DNA, 183 bp, Homo sapiens
aaaactggacttcatgctgagtatagatgatacatataaaagaagtcaaaatttggagaaaaaatttaaaaagataagtagaaaaatgaagtaactgtagaaaccatacttactctttgatctcaaatgcccaaaaactgaatgaaaatgtgaatttaggccgaccaggtagtcttgtcaata

SEQ ID NO: 2793 - DNA, 33 bp, Homo sapiens
tctgtctgtggcattaaatgaaccttaagaaca

SEQ ID NO: 2794 - DNA, 381 bp, Homo sapiens
cccttaacaggttctagtgactgagttcaactttttaaagactgagcaagcagattttttcttttaattgggttaaaaaaaaaaaagacaacatccactgttgtcttaatagatggattggttcaatggtagttaatagttatgaagaaatgattactagtttaaacagtctttaaaaagttctatggtataaagtttggggagcaatgaatattttttttgctttgattcagataattttaagggccttttaagtatgcaaaagggaaataattgttaaattgctagctgttaaacaagcccaaatttgatatactttttatatttaaaaaattatattcactgcccccataagagcaatcaaggcatgtctttaaattc

SEQ ID NO: 2795 - DNA, 52 bp, Homo sapiens
accaaggtcaccaaattcattgaaggtggtgatggtcatttatttgaagatg

SEQ ID NO: 2796 - DNA, 27 bp, Homo sapiens
aatacactaggatttctactggaggtg

SEQ ID NO: 2797 - DNA, 28 bp, Homo sapiens
gagacacgagaagaacgaatcattacag

SEQ ID NO: 2798 - DNA, 475 bp, Homo sapiens
gggccgactaccttcgctgtgattattttgaaatagtgttggtttagaaatattgaacatctgatattttctcttagttcttattttataaaaattgtgggaattatttcctcagctatgagttcttattagctggtcagaaataaaacatagttagcttttaatggatctagttggaattaatttatctattaagtcactgggcccaacaaaatgtcatgatttttgcatatacaagtgaggattgtggaataaaattgtaacattaatgtcagtataaaaggaaatattagaaacagtaggaaaaaatgaccattgtataagtctctgtctaataagccactccactactaggatttatgatagggctcccattccaatgatatagaactccctggattctcactaagtatttattccacatccagaaaacaagtatgacatggagagttaggatgtcaaatggccctctctc

SEQ ID NO: 2799 - DNA, 69 bp, Homo sapiens
aagtcaaaattgaaggtgaacctgaattcagactgattaaagaaggtgaaacaataactgaagtgatcc

SEQ ID NO: 2800 - DNA, 34 bp, Homo sapiens
aaaggactgttttaacatgataatttgtctccta

SEQ ID NO: 2801 - DNA, 41 bp, Homo sapiens
attaaagtgattgaaggcagtcttcagcctattatcaaaac

SEQ ID NO: 2802 - DNA, 26 bp, Homo sapiens
tcaactgctggaaatacttaataaat

SEQ ID NO: 2803 - DNA, 98 bp, Homo sapiens
tgatacacttctggtgaatgaattgaaatcaaaagaatctgacatcatgacaacaaatggtgtaattcatgttgtagataaactcctctatccagcag

SEQ ID NO: 2804 - DNA, 56 bp, Homo sapiens
cacctgacaccaggagttttcattggaaaaggatttgaacctggtgttactaacat

SEQ ID NO: 2805 - DNA, 72 bp, Homo sapiens
gctcctgacacaacctggagactggacattatttgtgccaaccaatgatgcttttaagggaatgactagtga

SEQ ID NO: 2806 - DNA, 72 bp, Homo sapiens
agggagaaacggtgcgattcacatattccgcgagatcatcaagccagcagagaaatccctccatgaaaagtt

SEQ ID NO: 2807 - DNA, 132 bp, Homo sapiens
gatcagcgcctccttaaattaattctgcagaatcacatattgaaagtaaaagttggccttaatgagctttacaacgggcaaatactggaaaccatcggaggcaaacagctcagagtcttcgtatatcgtaca

SEQ ID NO: 2808 - DNA, 114 bp, Homo sapiens
caaacaagttattgagctggctggaaaacagcaaaccaccttcacggatcttgtggcccaattaggcttggcatctgctctgaggccagatggagaatacactttgctggcacc

SEQ ID NO: 2809 - DNA, 157 bp, Homo sapiens
gtctattatgggaggagcagtctttgagacgctggaaggaaatacaattgagataggatgtgacggtgacagtataacagtaaatggaatcaaaatggtgaacaaaaaggatattgtgacaaataatggtgtgatccatttgattgatcaggtccta

SEQ ID NO: 2810 - DNA, 127 bp, Homo sapiens
agctgccatcacatcggacatattggaggcccttggaagagacggtcacttcacactctttgctcccaccaatgaggcttttgagaaacttccacgaggtgtcctagaaaggatcatgggagacaaa

SEQ ID NO: 2811 - DNA, 91 bp, Homo sapiens
ttgtgctcgaatcatccatgggaaccagattgcaacaaatggtgttgtccatgtcattgaccgtgtgcttacacaaattggtacctcaatt

SEQ ID NO: 2812 - DNA, 141 bp, Homo sapiens
ggagagcaacgtgaatgttgaattactgaatgctttacatagtcacatgattaataagagaatgttgaccaaggacttaaaaaatggcatgattattccttcaatgtataacaatttggggcttttcattaaccattatcc

SEQ ID NO: 2813 - DNA, 25 bp, Homo sapiens
gtaatgaggcttgggacaacttgga

SEQ ID NO: 2814 - DNA, 115 bp, Homo sapiens
catgtttatggcactctgggcatcgtgggagccaccacaacgcagcgctattctgacgcctcaaaactgagggaggagatcgagggaaagggatccttcacttactttgcaccga

SEQ ID NO: 2815 - DNA, 55 bp, Homo sapiens
aaagaaatacttcagcacttgtaagaactggtataaaaagtccatctgtggacag

SEQ ID NO: 2816 - DNA, 79 bp, Homo sapiens
ctattgctgcttattgttaaccctataaacgccaacaatcattatgacaagatcttggctcatagtcgtatcaggggtc

SEQ ID NO: 2817 - DNA, 36 bp, Homo sapiens
ttctcttcggggactaactgcaacggagagactcaa

SEQ ID NO: 2818 - DNA, 482 bp, Homo sapiens
gttgcaattatataggccatgggtggctcaaaactttgaacatttgagcttaaacaaatgccactctcatgcattctaaattaaaaagttaaaatgattaatagttcaggtggaagaaataagcatactttttgggttttctacacattttgtgtagacaattttaatgtcagtgctgctgtgaactaaagtatgtcatttatgctcaaagtttaattcttcttcttgggatattttaaaaatgctactgagattctgctgtaaatatgactagagaatatattgggtttgctttatttcataggcttaattctttgtaaatctgaatgaccataatagaaatacatttcttgtggcaagtaattcacagttgtaaagtaaataggaaaaattattttatttttattgatgtacattgatagatgccataaatcagtagcaaaaggcacttctaaaggtaagtggtttaagttgcctcaaga

SEQ ID NO: 2819 - DNA, 285 bp, Homo sapiens
agtttgagggctttcgcagaaatgctgtgattctgttttaagtccataccttgtaaataagtgccttacgtgagtgtgtcatcaatcagaacctaagcacagcagtaaactatggggaaaaaaaaagaagaagaaaaagaaactcagggatcactgggagaagccatggcattatcttcaggcaatttagtctgtcccaaataaaataaatccttgcatgtaaatcattcaaggattatagtaatatttcatatactgaaaagtgtctcataggagtcctcttgc

SEQ ID NO: 2820 - DNA, 435 bp, Homo sapiens
cctttggtccaaagcatctggaagaggaagaagagaggaatgagaaagaaggaagtgatgcaaaacatctccaaagaagtcttttggaacaggaaaatcattcaccactcacagggtcaaatatgaaatacaaaaccacgaaccaatcaacagaatttttatccttccaagatgccagctcattgtacagaaacattttagaaaaagaaagggaacttcagcaactgggaatcacagaatacctaaggaaaaacattgctcagctccagcctgatatggaggcacattatcctggagcccacgaagagctgaagttaatggaaacattaatgtactcacgtccaaggaaggtattagtggaacagacaaaaaatgagtattttgaacttaaagctaatttacatgctgaacctgactatttagaagtcctggagc

SEQ ID NO: 2821 - DNA, 161 bp, Homo sapiens
ggttcttgttcttcaccgcaggagaagatacaaaaagaaacaagtagatgagcaaatgagagacaacagtcctgtgcatcttcagtacagcatgtatggccataaaaccactcatcacactactgaaagaccctctgcctcactctatgaacagcacatgg

SEQ ID NO: 2822 - DNA, 536 bp, Homo sapiens
aaaggcatgttccttggtctccataatcttgaatacttatatcttgaatacaatgccattaaggaaatactgccaggaacctttaatccaatgcctaaacttaaagtcctgtatttaaataacaacctcctccaagttttaccaccacatattttttcaggggttcctctaactaaggtaaatcttaaaacaaaccagtttacccatctacctgtaagtaatattttggatgatcttgatttgctaacccagattgaccttgaggataacccctgggactgctcctgtgacctggttggactgcagcaatggatacaaaagttaagcaagaacacagtgacagatgacatcctctgcacttcccccgggcatctcgacaaaaaggaattgaaagccctaaatagtgaaattctctgtccaggtttagtaaataacccatccatgccaacacagactagttaccttatggtcaccactcctgcaacaacaacaaatacggctgatactattttacgatctcttacggacgctgtgcc

SEQ ID NO: 2823 - DNA, 83 bp, Homo sapiens
ttcactttggaaatgcttcacttgggaaacaatcgtattgaagttcttgaagaaggatcgtttatgaacctaacgagattaca

SEQ ID NO: 2824 - DNA, 456 bp, Homo sapiens
ggcttgacgatgcttcacacaaatgacttttctgggcttaccaatgctatttcaatacaccttggatttaacaatattgcagatattgagataggtgcatttaatggccttggcctcctgaaacaacttcatatcaatcacaattctttagaaattcttaaagaggatactttccatggactggaaaacctggaattcctgcaagcagataacaattttatcacagtgattgaaccaagtgcctttagcaagctcaacagactcaaagtgttaattttaaatgacaatgctattgagagtcttcctccaaacatcttccgatttgttcctttaacccatctagatcttcgtggaaatcaattacaaacattgccttatgttggttttctcgaacacattggccgaatattggatcttcagttggaggacaacaaatgggcctgcaattgtgactta

SEQ ID NO: 2825 - DNA, 32 bp, Homo sapiens
tgctaataaattgtgaagcaaaaggtatcaag

SEQ ID NO: 2826 - DNA, 46 bp, Homo sapiens
aggctcttgtgattctctttgcaattgtgaggaaaaagatggcaca

SEQ ID NO: 2827 - DNA, 76 bp, Homo sapiens
agctgtggattcatctcttttattcatctctccttgcctgtatatctttacactcccaaactccagtgctctcatc

SEQ ID NO: 2828 - DNA, 30 bp, Homo sapiens
ataacgtcaggaagagtctctgctttacag

SEQ ID NO: 2829 - DNA, 392 bp, Homo sapiens
ggagaacattgctgtagcttggatctacaacctaagaaagcaagagtgatcaatctcagctctgttaaacatcttgtttacttactgcattcagcagcttgcaaatggttaactatatgcaaaaaagtcagcatagctgtgaagtatgccgtgaattttaattgagggaaaaagggacaattgcttcaggatgctctagtatgcactctgcttgaaatattttcaatgaaatgctcagtattctatctttgaccagaggttttaactttatgaagctatgggacttgacaaaaagtgatatttgagaagaaagtacgcagtggttggtgttttcttttttttaataaaggaattgaattactttgaacacctcttccagctgtgcattacag

SEQ ID NO: 2830 - DNA, 34 bp, Homo sapiens
ctgacagaagggctgccaaactgcactccagaca

SEQ ID NO: 2831 - DNA, 33 bp, Homo sapiens
gcctgattcagcaggaagcatctcagacaccaa

SEQ ID NO: 2832 - DNA, 102 bp, Homo sapiens
gctaccagggctggtttcatccctgtgctaggctttctgtgaggatgagcagcaccgggatagacaggaagggcgtcctggctaaccgggtagccgtggtca

SEQ ID NO: 2833 - DNA, 145 bp, Homo sapiens
atcggctttgccatcgcccgacgtctggcccgggacggggcccacgtggtcatcagcagccggaagcagcagaacgtggaccgggccatggccaagctgcagggggaggggctgagtgtggcgggcattgtgtgccacgtgggga

SEQ ID NO: 2834 - DNA, 43 bp, Homo sapiens
gtgtgcagcgcaggggtcaaccctctggtagggagcactctgg

SEQ ID NO: 2835 - DNA, 98 bp, Homo sapiens
tctctcctagaagggggctcctcactgagtcccacacaaacttgccgacaggaccagatccagccatcagcattccgggggcttagacatcccagcct

SEQ ID NO: 2836 - DNA, 709 bp, Homo sapiens
gtgcgccctctttcaggctcatggatagttctctgctcagaactacttggcacactgagctactctctcttactttctaatggggcagttttcttcatcaagggagggagtctcaccttttctttggcttggtttttgttcctgagtccaggaggggtcttacctcagcccctcactcagcctgatgcacatggagtattggacagatatcctgtgggctggttggggtctgttttgaccaggaaacccttacagctaacctaatcctcaattccttcttattagggacctcagggtggtacccacttctgacatctggaccacttcttgcagtcattgggggtcatcccccacactggtaacctgtcatcaaatgggccacagcaacattcagcttaagtatttctccttcccacatccaagggattgagtgggagtgagattggggggtggaaaaaacagtgaacagtcctggtgagttgcagatgtggtctcattccctagagatgcaggatgcagctgacctgaatcaggacagatccctgcaggagggactcctggtgccatgtcagtcccacctggcactgccctagctcccaggctccgcctctgcatctttccttgctacttcctctttcacttctcccccgttcccagacccaccagacagagcttccagagtgtcaggacatgtgtgacttagcccaga

SEQ ID NO: 2837 - DNA, 28 bp, Homo sapiens
gccagttgctgccctacatggagaacag

SEQ ID NO: 2838 - DNA, 513 bp, Homo sapiens
cttggccttgacatcagcaggtttgggacaaggctatgctttaactccttgaccttgtgggctggtcattgtcaccttacctgctctctgttcttaccaacttaaaaccaatgacagggttagccccattcctctccataggaaaaagcctgtcccagacctctcctcatgcctgcgcttggtctccagggaccctgcctgtgttccaggtcctgcagatctgactgtacccctcacagacacacccttaggaactggccaggggctgtcttcagtagaaggaaagttcctgactgtcacttctggtctcccttaccccatctgctccttagaggttgctcattgataggcactcaccatcagccttgggtgcctcttcacaaagcccaccctgccctctccttcaagcacctggcaagagaggaagcagaagataagggttctgagcatggacatcgtatttatgagaaataggcatggaatcctagctctgccgtgtattggctggtacta

SEQ ID NO: 2839 - DNA, 31 bp, Homo sapiens
aggggtgctgtcatcctggtctcttccattg

SEQ ID NO: 2840 - DNA, 156 bp, Homo sapiens
atagggtgaggggcaactttgttcttttcctcagagccttacagacaaagtgcctgggacagacccccaccatcctcctgctgccctgggctgagcttgtctccatgtgggtgggagggctgctgggcctgtgagatccctgtaggtgagaaatcc

SEQ ID NO: 2841 - DNA, 64 bp, Homo sapiens
gcgctgggtgtctacaatgtcagcaagacagcgctgctgggtctcactagaacactggcattgg

SEQ ID NO: 2842 - DNA, 27 bp, Homo sapiens
gtaaactgcgtggttccaggaattatc

SEQ ID NO: 2843 - DNA, 179 bp, Homo sapiens
ctgaatccttaggtcagcatgcctatgactgaggtcctcattgttctctgaactcagccatggtgcagtccatccatcctgaaaagatgctccttcttttgagaagggcaaagctgccctaggtgttctgcctggtggccttcccggggccctgcccatcttgttttagtagcactgac

SEQ ID NO: 2844 - DNA, 49 bp, Homo sapiens
tcatgggaatgagtctctctggaagaacttcaaggaacatcatcagctg

SEQ ID NO: 2845 - DNA, 178 bp, Homo sapiens
gttgagtctattgcaagagcagacccctccctgtcatctggccattgtttttgctgaaatctggagtccacatggccctggagggtgcaagtagccctgctgcatccaccttgttccccatggagcccactcccacctgtcatccgtgagccccagagcagcagaatcagagtacaag

SEQ ID NO: 2846 - DNA, 70 bp, Homo sapiens
ggactgtgcaggaatcgtgtccttcctgtgctctccagatgccagctacgtcaacggggagaacattgcg

SEQ ID NO: 2847 - DNA, 27 bp, Homo sapiens
gtggcaggctactccactcggctctga

SEQ ID NO: 2848 - DNA, 26 bp, Homo sapiens
gcggctgcgtagctgtggtcccaggc

SEQ ID NO: 2849 - DNA, 113 bp, Homo sapiens
gccattctgccagactagcaatttgggggcttactcatgctaggcttgaggaagaagaaaaacgcttcggcattctccttaggacttatctgcttgtagatttggctgatcca

SEQ ID NO: 2850 - DNA, 29 bp, Homo sapiens
ctcctgtcacccagtagagtaaataaact

SEQ ID NO: 2851 - DNA, 26 bp, Homo sapiens
tggttgatgtatctgggtctcctctg

SEQ ID NO: 2852 - DNA, 834 bp, Homo sapiens
cctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctca

SEQ ID NO: 2853 - DNA, 160 bp, Homo sapiens
attacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagta

SEQ ID NO: 2854 - DNA, 130 bp, Homo sapiens
caataagcatgcgttttctggagggagagacaccatcgaggagcacaggcagtttgggggcaactgtgatgtggacgtgtctttcatgtacctgaccttcttcctcgaggacgacgacaagctcgagcag

SEQ ID NO: 2855 - DNA, 268 bp, Homo sapiens
agccagcgggatcagaaacatgccctggggggcacacgcacacacacaccactgcgcagtgctttgggcctcagccacccagccaccgtagcaatgctgaactccaggattgccaactttgctccctgcagaactcaaggcagcctgtccttcccacatgaatcaggtgaatttgttttgtgtcctttcatttaggtaaaattttgaattttttttctttttttccttttctgcttttcttatcagcactgttctgcaggcaaagtca

SEQ ID NO: 2856 - DNA, 115 bp, Homo sapiens
gatcggctatcctaaaccagccctgctgcactccaccttcttcccagccctgcagggcgcccagaccaaaatgagtgccagcgaccccaactcctccatcttcctcaccgacacg

SEQ ID NO: 2857 - DNA, 53 bp, Homo sapiens
ccctccttcagcaactcattcccacagatcttccgagacaggacggatatcca

SEQ ID NO: 2858 - DNA, 100 bp, Homo sapiens
atgagctcaggtttctacaaaaatgtggtgaagattcaaaagcatgttaccttcaaccaagtgaaaggcattttcggcttcactgacagcgactgcattg

SEQ ID NO: 2859 - DNA, 101 bp, Homo sapiens
tcttgccaaggatagtcagtcttccagagttatgtcttcctccttttcaacgcaccttttcctcacagagaaaagactcagtggttacacagtttcctcag

SEQ ID NO: 2860 - DNA, 58 bp, Homo sapiens
ccaaggacatcatcgcctgtggctttgacatcaacaagactttcatattctctgacct

SEQ ID NO: 2861 - DNA, 69 bp, Homo sapiens
gtggctccaggatgtatttaacgtgcccttggtcatccagatgacggatgacgagaagtatctgtggaa

SEQ ID NO: 2862 - DNA, 375 bp, Homo sapiens
tgggctcactttagaggaccatggagtgatggggagagcgcagctttggagtcagccaggcctgctcctcttctcatcctgctccctgtctgcatggccatgggcctgctacttctctgagcctaagtttccacatctgcaagatgagaatgaagatacctacctcatagaactactgtaaagcttcaaaacaaagtgtgtagagcagctaacacagagcacacagggccacctggtcgataaatggtagtagaccttatcattatccatagtcaaattcatatcacaattcaaattgtgattttgtaggcaaggaagttttaacatacgttgtaagtaggagctgtgttttcagatgcacgatggcgttcctcc

SEQ ID NO: 2863 - DNA, 102 bp, Homo sapiens
atcaggttcttgatgcctatgaaaataagaagccattttatctgtacacgggccggggcccctcttctgaagcaatgcatgtaggtcacctcattccattta

SEQ ID NO: 2864 - DNA, 68 bp, Homo sapiens
gctaataaaccgaatagagagagccaccggccaaagaccacaccacttcctgcgcagaggcatcttct

SEQ ID NO: 2865 - DNA, 150 bp, Homo sapiens
gggaggattacaaggctgactgtcctccagggaacccagcacctaccagtaatcatggcccagatgccacagaagctgaagaggattttgtggacccatggacagtacagacaagcagtgcaaaaggcatagactacgataagctcattg

SEQ ID NO: 2866 - DNA, 30 bp, Homo sapiens
tgagttcgagcgattctcctgccctggcct

SEQ ID NO: 2867 - DNA, 32 bp, Homo sapiens
taaggtccctcaaagcgggaaatgcgtcaaag

SEQ ID NO: 2868 - DNA, 57 bp, Homo sapiens
acagtgagcccgcatctctgctggagctgttcaacagcatcgccacacaaggggagc

SEQ ID NO: 2869 - DNA, 30 bp, Homo sapiens
gccggctgtgaacgtagttcctgagagata

SEQ ID NO: 2870 - DNA, 27 bp, Homo sapiens
gtctgctgaacaaatcctctgacctca

SEQ ID NO: 2871 - DNA, 84 bp, Homo sapiens
gtgaatctacttctcttaacaaagtctcaatgtcctatttgcaatttatgtggtaaacactgaagacaatggtccttaaccttt

SEQ ID NO: 2872 - DNA, 33 bp, Homo sapiens
aactgcccagcgtgaccagtggccacctctgca

SEQ ID NO: 2873 - DNA, 26 bp, Homo sapiens
gaagagtattaaagaccatttctggc

SEQ ID NO: 2874 - DNA, 25 bp, Homo sapiens
ttataagaaacccttagctgaatgc

SEQ ID NO: 2875 - DNA, 598 bp, Homo sapiens
tggccctcccgggagtatccttagagcccggcttgctgcccgccgcgttctggcactgtgaggcgcggagcctgccaccgacccctcgcccctttcctctgagcgccgccgacccaccccgtctccctttcccactggcacccttcatcgtctccgcctgttcgcttttcccgaggagagaggcccccatttttatttagcgcctgccatgtgccagaggctttgcgtagtgttgcacttagtcccctcaacggtaatgttagcaggcttctccatgcccattccacagatgaggaaaccgaaggggaagcagaaaagtaatgcgacccttgcccaaggtttcgaataagtccaagctgggattgaaacccaggcgtctgtgaccccagaactcctgatctttccactgcactgtgccgcctcggtgaacagatgcggggaatttacagtttctctttccaccgcccacgactacacaaaatcagtcacactgacgctgagggtggggaacgggaagagggtggggaggttatttggaggccagcggggggtgaggggtggctgatgcaatgaccagctaatggctcgattctcaaga

SEQ ID NO: 2876 - DNA, 341 bp, Homo sapiens
gttggtccaaggcacagcgctttctgaaggaacaggaagtgaaaggaaggcgagcggctatgagagaccgcgttaagcggcacggggcgctttaggcgctgcccagtcccggcccctccagcccggggcccgccgctcaccacacgcaccggaagcgctcggttctcccggaggcagaccggccagcacactaccatccagtcacgttccgacgcgacgccgcggccgccagccaatcagtggcggcctctgccccgcccccgcgcgaacagccaatgacggcgccgtcgggccggaagttgttccgtccggacggcgtttccacggacgcccaggagaca

SEQ ID NO: 2877 - DNA, 29 bp, Homo sapiens
gatccctgctgggcaccaacagctccacc

SEQ ID NO: 2878 - DNA, 55 bp, Homo sapiens
gcctggggactaggcgtcctgttcctgatgcatgtgtgtggcaccaaccgcattc

SEQ ID NO: 2879 - DNA, 341 bp, Homo sapiens
ttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtga

SEQ ID NO: 2880 - DNA, 97 bp, Homo sapiens
tggccaatgagctgaggcggcctcccctatgctatcacaacggagttcagtacagaaataacgaggaatggactgttgatagctgcactgagtgtca

SEQ ID NO: 2881 - DNA, 61 bp, Homo sapiens
ctgcaaaaaggtgtcctgccccatcatgccctgctccaatgccacagttcctgatggagaa

SEQ ID NO: 2882 - DNA, 386 bp, Homo sapiens
ctcacggccgagttggagccagaaccaacaacagctcggctgccttcacactcatctgtcaaacacatggtgtatggctcccctgacagaaatgactcctataagcttcctcatactcgcgcattcttggaagtctgagactggaaatgcctacccagatatgttaagtcagtaaaggaaaactcatttgcaatgctgagaggagaaagaaaatcaatgaataggagagcatacactgtgggaaggctcagctgtactgagccaggcaaagcatccgattaccccactgctgtacacatcatgacctgggataaacccctgggccgttggcctaagaaatatgttgcttttcatcctgtataactgcaactttgtgccggctcata

SEQ ID NO: 2883 - DNA, 135 bp, Homo sapiens
catggtccgagtggacctcctgttctacgagctgtggcaatggaattcagcagcgcggccgctcctgcgatagcctcaacaaccgatgtgagggctcctcggtccagacacggacctgccacattcaggagtgtg

SEQ ID NO: 2884 - DNA, 82 bp, Homo sapiens
gatggtgtgatcacaaggatccggctctgcaactctcccagcccccagatgaacgggaaaccctgtgaaggcgaagcgcggg

SEQ ID NO: 2885 - DNA, 120 bp, Homo sapiens
ccagctggttgcctggcatctgcagcctgcagttcagtgggtcatagagcaggaaggttacctactagagaaacaaacagaagcaaagtcctgcaggctcagcaacttcttttaatgaaa

SEQ ID NO: 2886 - DNA, 149 bp, Homo sapiens
ggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtcca

SEQ ID NO: 2887 - DNA, 30 bp, Homo sapiens
gccacgcagcccaggatgaaacgacccagg

SEQ ID NO: 2888 - DNA, 100 bp, Homo sapiens
tgctttgccggcgtgaagtgtactagctaccctgatggcagctggaaatgtggtgcttgtccccctggttacagtggaaatggcatccagtgcacagatg

SEQ ID NO: 2889 - DNA, 127 bp, Homo sapiens
tcaaccacaatggagagcaccggtgtgagaacacggaccccggctacaactgcctgccctgccccccacgcttcaccggctcacagcccttcggccagggtgtcgaacatgccacggccaacaaaca

SEQ ID NO: 2890 - DNA, 182 bp, Homo sapiens
gatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttacca

SEQ ID NO: 2891 - DNA, 65 bp, Homo sapiens
attgccccaaccttcccaactcagggcaggaagactatgacaaggatggaattggtgatgcctgt

SEQ ID NO: 2892 - DNA, 81 bp, Homo sapiens
cattccattacaacccagctcagtatgactatgacagagatgatgtgggagaccgctgtgacaactgtccctacaaccaca

SEQ ID NO: 2893 - DNA, 116 bp, Homo sapiens
tatcctcaatgaacgggacaactgccagtacgtctacaatgtggaccagagagacactgatatggatggggttggagatcagtgtgacaattgccccttggaacacaatccggatc

SEQ ID NO: 2894 - DNA, 185 bp, Homo sapiens
ggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgaca

SEQ ID NO: 2895 - DNA, 128 bp, Homo sapiens
tgacatcagtgagaccgatttccgccgattccagatgattcctctggaccccaaagggacatcccaaaatgaccctaactgggttgtacgccatcagggtaaagaactcgtccagactgtcaactgtg

SEQ ID NO: 2896 - DNA, 29 bp, Homo sapiens
tatgatgagtttaatgctgtggacttcag

SEQ ID NO: 2897 - DNA, 143 bp, Homo sapiens
accgaaagggacgatgactatgctggatttgtctttggctaccagtccagcagccgcttttatgttgtgatgtggaagcaagtcacccagtcctactgggacaccaaccccacgagggctcagggatactcgggcctttctgt

SEQ ID NO: 2898 - DNA, 39 bp, Homo sapiens
gtaagaagcaaagccctggaacagagagagagcttatgg

SEQ ID NO: 2899 - DNA, 297 bp, Homo sapiens
tgtgctttgaccaagactctgaccagggagtcttagaaagttcccagcatcaccagctgcagcattgaactctgctttgtaaaaacataatagtgttgaaaagggagcttgaccaagaattgccctgcaaatcctaaggtgccttcagccttttcaaacaaaaaaacctccttccctcctctctgtctgctttatatgtgtgctcagtggcacacaacaaatatgagaggacttggaaaaattccccattgcagccctctaacttagatcagctcagtacctttcaagcattgtttc

SEQ ID NO: 2900 - DNA, 89 bp, Homo sapiens
cctgtggcatgaccctcgtcacataggctggaaagatttcaccgcctacagatggcgtctcagccacaggccaaagacgggtttcatta

SEQ ID NO: 2901 - DNA, 69 bp, Homo sapiens
gctgactcaggacccatctatgataaaacctatgctggtggtagactagggttgtttgtcttctctcaa

SEQ ID NO: 2902 - DNA, 629 bp, Homo sapiens
gctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctga

SEQ ID NO: 2903 - DNA, 50 bp, Homo sapiens
tggccagaattagggaatcagaatcaaaccagtgtaaggcagtgctggct

SEQ ID NO: 2904 - DNA, 548 bp, Homo sapiens
aggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgtttt

SEQ ID NO: 2905 - DNA, 181 bp, Homo sapiens
gttctctactggctttatgtcatgaagtatatgcgtaaataccattcataaatcaatatagcatatacaaaaataaattacagtaagtcatagcaacattcacagtttgtatgtgattgagaaagactgagttgctcaggcctaggcttagaatttgctgcgtttgtggaataaaagaaca

SEQ ID NO: 2906 - DNA, 69 bp, Homo sapiens
cattagcctgccatatcaaaaacatataaaagagaaattatccctaagtcaagggcccccataagaata

SEQ ID NO: 2907 - DNA, 25 bp, Homo sapiens
ttagatgtcattgaatccttttcaa

SEQ ID NO: 2908 - DNA, 787 bp, Homo sapiens
agcgacattttctgacccacgaatgatgccttgggtgggcaacacgattgcatgttgtggagacacttcggaagtaaatgtggatgagggaggagctgtccttgcaatgttgagccaagcattacagatacctcctcttgaagaaggaataataagtttaatcaaaaaagaagactaaaaaatgtaaaatttggaaggaatccataaatgcgtgtgtgtctaaatacaaattatcatgtgaagaaaaggcccaagtgtaccaataagcagaccttgatttttggatgggctaattatgaatgtggaatactgaccagttaatttccagttttaatgaaaacagatcaaagaagaaattttatgagtaggttaaaggtctggctttgaggtctattaaacactagaaaggactggctgggtgagataaaatcttccttgttgattttcactctcattctataaatactcatctttctgagtagccatgatcacatacaaatgtaaattgccaaatcattttatagtaccaaggtgaagaagcaggaactagaaagtgttgataatagctgtggagttaggaaaactgatgtgaaggaaataattctttgaaatggcaaagaattaaataccatcattcattatcagaagagttcaacgtttgaagtgctgggagataattctaattcattcttggatagtgaagcaaaactgattgaaaataccaagataagacagaaaaagtgactggaaagaggagcttttcttccaggcatgttccagtttcacc

SEQ ID NO: 2909 - DNA, 183 bp, Homo sapiens
gtcatcgagatgatagcttttttcctcctccaacagtttattgtcatgtgttgtgggagagctcgagtgaagagcaataaactccaggtcttataagaatgtacatacaataaaggtggtgccagcagtttttttttttctaaagagtcacatgtagaaaagcctccagtattaagctcctga

SEQ ID NO: 2910 - DNA, 25 bp, Homo sapiens
tcatcctggagaccttccgacactc

SEQ ID NO: 2911 - DNA, 657 bp, Homo sapiens
aaggcgcttcgcttttcagacctgggcgtctgtatcatgactatcataaatttaggattaagacacctagcctcctaccaggatgaatgaggtgtccatgtgacctgctgtgccctggaattttatacatctttctctcatagcacacaccatattacaatataatcctgcctcatctaagccaaactttcgagagaatcatttacactcagtggctacttcagctcccattcacttatcaacctgctgcaatttttcacagcccccaaaggactgcagtctgtgccttcagggagctgagggtctagcggaaggaaagaaaccagcagttacagtacagaggggtttgtgttggaaactctacaaacacaggatgccctggtagctcagaggaagtgcatatcgagcatggtaggtaggtagtgggaagagccaagatgacttcccagaggagaaaagctggacctgagttttggagtttcggtaaaagtttgctctaactagtccaagctgctgtcacaagcttttagaaatgatgtaaccatggggcagttgactgtcgtcatgttctttgctattttcatgactctggatgtgcttttcctattccctggattgccctttccctcgattcctctgcaggactgggctttatta

SEQ ID NO: 2912 - DNA, 186 bp, Homo sapiens
caaagttttgaatgctaagtacctcatttattttaaaaagcctagtttaatgataagtttgtttaaaattttgagccatcatttttctcttcatagcaaataaggagagaattgacatttcagtgttacctagaaaaggaattgtaagcccagaataattccctgcatgaggtaatctgcttcaaa

SEQ ID NO: 2913 - DNA, 165 bp, Homo sapiens
tactctttgaactctgagaactatcacaagaagcttcccacaaggcagtgttttcttacagttgtctcttcctacaaaagtatagattatctttattcttaatactttggaatccatgtagaaaatttccagttagatactctgcgtacacacaataaacctttt

SEQ ID NO: 2914 - DNA, 25 bp, Homo sapiens
aaacttgaaatgcattaataaatag

SEQ ID NO: 2915 - DNA, 839 bp, Homo sapiens
gctgctacgggcacaagtgactatactgaagaacacagttaagtgttgtgcaaactggacatagcagcacatactacttcagagttcatgatgtagatgtctggtttctgcttacgtcttttaaactttctaattcaattccatttttcaattaataggtgaaattttattcatgctttgatagaaattatgtcaatgaaatgattctttttatttgtagcctacttatttgtgtttttcatatatctgaaatatgctaattatgttttctgtctgatatggaaaagaaaagctgtgtctttatcaaaatatttaaacggttttttcagcatatcatcactgatcattggtaaccactaaagatgagtaatttgcttaagtagtagttaaaattgtagataggccttctgacattttttttcctaaaatttttaacagcattgaaggtgaaacagcacaatgtcccattccaaatttatttttgaaacagatgtaaataattggcattttaaagagaaagcaaaaacatttaatgtattaacaggcttattgctatgcaggaaatagaaggggcattacaaaaattgaagcttgtgacatatttattgcttctgttttccaactacatcacttcaactagaagtaaagctatgattttcctgacttcacataggaggcaaatttagagaaagttgtaaagatttctatgttttgggtttttttttttcctttttttttttaagagtataaggtttacacaatcattctcataatgtgacgcaagccagcaaggccaaaaatgctagagaaaataacgggatctcttccttgtaaacttg

SEQ ID NO: 2916 - DNA, 106 bp, Homo sapiens
ggctcgaccacctcaacattggagacatcacttgccaatgtacataccttgttatatgcagacatgtatttcttacgtacactgtacttctgtgtgcaattgtaaa

SEQ ID NO: 2917 - DNA, 26 bp, Homo sapiens
tatatttttttcaactgccaatcaag

SEQ ID NO: 2918 - DNA, 213 bp, Homo sapiens
agatcatatcctcagaccaggtggaattacttaaattttaaagcctgaaaattccaatttgggggtgggaggtggaaaaggaacccaattttcttatgaacagatatttttaacttaatggcacaaagtcttagaatattattatgtgccccgtgttccctgttcttcgttgctgcattttcttcacttgcaggcaaacttggctctcaataa

SEQ ID NO: 2919 - DNA, 38 bp, Homo sapiens
ccaaagagaaacctattaagtcatcatctccaaactaa

SEQ ID NO: 2920 - DNA, 28 bp, Homo sapiens
ctgcagcttttgccttggttcttcctag

SEQ ID NO: 2921 - DNA, 45 bp, Homo sapiens
cagcggccccgagagagttatcaaatgggacacatgagacgctaa

SEQ ID NO: 2922 - DNA, 108 bp, Homo sapiens
ctcattggtgggcagtattacttatgggaattgctctgatcatgctaatggctggatttattaagatatgcagtgttcatactccaagtagtaatccaaagttgcctc

SEQ ID NO: 2923 - DNA, 887 bp, Homo sapiens
tctgttttaccgtgctccttagttcatctcctggatgggttacttcttttggtgcatattattagggcattttcatgggacttaaaaaacatttttttttgttgtttttcaagacaacttatttgcccaaatcgtggactaattggtgatttttcctgatctttcagtataatctctgggtctttatcttgtttgtaataggaaatgttgaacagaataagatcagatacacagccttttgtagatctactaatgattatggatgttcatccagcagtaatccactgaacgcttatttttaagcccacatatctccaagttgtacaaacacagaattacctgatgttttcttaaaagattgtcaagattgactatctcaacttaagtgttcatgctttaaaagtgataacattaaaatatctataggaagcttgcaaatgatatatttgagaatgtgctataattgaactgaatgtagtttgctttggaaattgacttataactcacattcccctttctcaaattagtgtgtatgtgtgtgtgtgtgtatgtatgtatgtgtgtgttcagaactatggatgccttaaagcacaaaagatgttgtttgtgtgggatgtcagccttttttgtactcttctaataacattctagagtaaaaattttatagttaaccccagcatttaaaatgatgtttaccgttcctaggacacattaggatatgtggtttttagatatgtaatgatcatggagtagaaggattgttgaaattggatttaggagatctacctaggtttcaaaccaaatacttgagcagttgacttaacttaggtttccttaaaacatgttactctttttttaaattcctgtgcttgttgcgtggtaagttc

SEQ ID NO: 2924 - DNA, 164 bp, Homo sapiens
taggcacttcagtggtcgaaccatcaccctgcaacctggatccccttgcaacgattttagaggttactgtgatgttttcatgcggtgcagattagtagatgctgatggtcctctagctaggcttaaaaaagcaatttttagtccagagctctatgaaaacattg

SEQ ID NO: 2925 - DNA, 27 bp, Homo sapiens
tggacccatcaacttgtgccagtacag

SEQ ID NO: 2926 - DNA, 274 bp, Homo sapiens
tgacctacagtttggccagataatttccagctaaatctgtcctcttgaggagattataaatgtaacgtagcattgtgtctctattattatggtctctacaatgttttaaaaatgataaactagacaaaacgttgccagctttacagcagtaatttacataaacactgttagactttaagtcatcgtggacactgagtcaagacttgctggttgcttgtttacattgtaacatttaatatgaattactgatggcgttacccagcctaactagaga

SEQ ID NO: 2927 - DNA, 93 bp, Homo sapiens
tctgtgagaaatatggcttagaggagtgtacgtgtgccagttctgatggcaaagatgataaagaattatgccatgtatgctgtatgaagaaaa

SEQ ID NO: 2928 - DNA, 460 bp, Homo sapiens
ccatgtacatgtggttgatattctctagagaaacatagttgtacaactcggcatgtgatttgtctataatatttaagttttataaaataatatttcagtagcctaaataaaagaactctttggtcatcttctctgaatatcaaaccttcaaagcttttgtggctgaatatcactttgctctacaggaaaaaaatttaatttttctttctttatagaagagccgtaataaccaacataaaatcgatcctcatctaatctcttgctctgcttttatttcatttttttaagttgccattgctttaaaagatttactatctttcttggatttactgtttttcaaattttttcaaatgtatttatgtaattcagttttgatactcatctctgtttgtttttcactttcatttccatttaaatattttgacattggaagctcatacttgcctgtctgttactataa

SEQ ID NO: 2929 - DNA, 170 bp, Homo sapiens
gtcaaggtccttgttgtacagcacagtgtgcattcaagtcaaagtctgagaagtgtcgggatgattcagactgtgcaagggaaggaatatgtaatggcttcacagctctctgcccagcatctgaccctaaaccaaacttcacagactgtaataggcatacacaagtgtgc

SEQ ID NO: 2930 - DNA, 45 bp, Homo sapiens
tgtaaagatgaatgctgcttcgatgcaaatcaaccagagggaaga

SEQ ID NO: 2931 - DNA, 80 bp, Homo sapiens
acatcatgtatgcaagagcaacatctggggacaaacttaacaacaataaattctcactctgtagtattagaaatataagc

SEQ ID NO: 2932 - DNA, 91 bp, Homo sapiens
cactggaattattactgttcagaactatgggtctcatgtacctcccaaagtctctcacattacttttgctcacgaagttggacataacttt

SEQ ID NO: 2933 - DNA, 25 bp, Homo sapiens
tctggaggaatatgtgaaaaaagta

SEQ ID NO: 2934 - DNA, 32 bp, Homo sapiens
gattttgatgatggcgtacttggtctggcttg

SEQ ID NO: 2935 - DNA, 83 bp, Homo sapiens
tcccaaatattggtgtggagaagtttctggaattgaattctgagcagaatcatgatgactactgtttggcctatgtcttcaca

SEQ ID NO: 2936 - DNA, 75 bp, Homo sapiens
tccagtcatgttaaagcgattgatacaatttaccagaccacagacttctccggaatccgtaacatcagtttcatg

SEQ ID NO: 2937 - DNA, 126 bp, Homo sapiens
ctgctaatggtccagaacttctgaggaaaaaacgtacaacttcagctgaaaaaaatacttgtcagctttatattcagactgatcatttgttctttaaatattacggaacacgagaagctgtgattg

SEQ ID NO: 2938 - DNA, 35 bp, Homo sapiens
gcttcctgagacctctctagaagccaagcggatgc

SEQ ID NO: 2939 - DNA, 39 bp, Homo sapiens
tgaggaaataccagatgactggtgtagaggaagtaacac

SEQ ID NO: 2940 - DNA, 81 bp, Homo sapiens
ggcttagaaaacttatgtcacttgattgtggacctcctgttctttaccctgtgctcttctgcttcactcatggaagaaagc

SEQ ID NO: 2941 - DNA, 106 bp, Homo sapiens
ggaagttttagccatgggtctgttattgatggaagatttgaaggattcatccagactcgtggtggcacattttatgttgagccagcagagagatatattaaagacc

SEQ ID NO: 2942 - DNA, 41 bp, Homo sapiens
catttcaacctacgaatgaagagggacacttcccttttcag

SEQ ID NO: 2943 - DNA, 34 bp, Homo sapiens
ccattaatctccagcgttcattcgactgatctgg

SEQ ID NO: 2944 - DNA, 105 bp, Homo sapiens
aggattatcttacaatgtggattcattacaccaaaaacaccagcgtgccaaaagagcagtctcacatgaagaccaatttttacgtctagatttccatgcccatgg

SEQ ID NO: 2945 - DNA, 265 bp, Homo sapiens
atttccagagtcctttattgcattaagcattggttaaaaggctaatttttggtgtttttgttaagcagaactttttcaaaaaacataagacaagttttattagttttattttaaaattagtatcaagattctagcttttgggtacttggagatacttgtaattttattgtaactatggggtatttttatctactaatctgagctatttttggtcacttgtaagatctttgtatgatgatttgtagacttcagcacattgagattg

SEQ ID NO: 2946 - DNA, 138 bp, Homo sapiens
catcaagcaagacacacattatagattaagagctgataatagatgtttagttttaaaaaggattatgtgcgggagactctctgttagaggagcctttttcatctgacatttgttatttctgttctaaacgtggctttc

SEQ ID NO: 2947 - DNA, 36 bp, Homo sapiens
tttctgtcctgtattctaccgagtccgagggtggta

SEQ ID NO: 2948 - DNA, 103 bp, Homo sapiens
gctttggatgagtgtctgtagcctttgataatttagaaaatatctatttcatgtaatgtattgtttctgtttttttctttgccactttgacttatgactgcag

SEQ ID NO: 2949 - DNA, 102 bp, Homo sapiens
tctcttagagtagaagttcggtccctgggtgacccaacttgaagagtttcgttaaactttcaggtggagtagatgtacagtgtagttagtggattgtcaaaa

SEQ ID NO: 2950 - DNA, 25 bp, Homo sapiens
accatttggggatgttctttgattt

SEQ ID NO: 2951 - DNA, 148 bp, Homo sapiens
ctcgtgggaagttgtgttgtttgcagctgggctcgtgtattgttctttacccggcgcgccggtcctgaccgaccccattctgcagaggggccgcccgtggagtggcagcagtcatcacccgcttatctgagactagtggcctcggttc

SEQ ID NO: 2952 - DNA, 52 bp, Homo sapiens
atggtgttgctgagagtgttaattctgctcctctcctgggcggcggggatgg

SEQ ID NO: 2953 - DNA, 45 bp, Homo sapiens
cttctccctccggatcgatgtgctgctgttaacccgtgaggaggc

SEQ ID NO: 2954 - DNA, 117 bp, Homo sapiens
tccctgttttggaggagctaggagcgttgccggcccctgaagtggagcgagagggaggtgcttcgccgtttctcctgccaggggaggtcccggcttcccgtggaggctccggaccaa

SEQ ID NO: 2955 - DNA, 63 bp, Homo sapiens
cggcaggcctagcagcacgggaaccgtcccccgcgcgcatgcgcgcgcccctgaagcgcctgg

SEQ ID NO: 2956 - DNA, 295 bp, Homo sapiens
gctagggtgaactcttgaagctatcagtcatccagcaatcttagcaagcaggccattgggtccctgtttgctctgtctctctctctctctctcactgttgaagggcttagctaactacttaagtaaaatatttgttctctgttaaacatgtcaaggagtatggtcagcttatccacattaagcctgtgtgtcccacgttggagtaaatgttaagtagctcactacaataaactagattcttctgccctctcttgtttaaatgatcatgttccctggaggtggaaatagatcttta

SEQ ID NO: 2957 - DNA, 356 bp, Homo sapiens
tggccaaggctgagataactttagcatcagcaaggataatatctgcaagagattgaaactcatagtattgtatttaactctgtgagttaatgatggtagtggacagaattatagttacctttgggatacgcttttaaagaaattccaggtaataagagaaatgatagaattaggatatcaccattttacccccccaacaatttatggatctagacaataatcgccagtgactgctaacctcacaaagtgagagcaatcagattttgtgcctcctaatggaagtacatataccacctatgaagcagttctgccaaaagtcacatctcatcatgatgaagcctcctgatctaactacc

SEQ ID NO: 2958 - DNA, 91 bp, Homo sapiens
ttgattgggcagacccagggaagtcaaatcctaaaccagcagtgggaacacaacagaatggtgtagtttgcactggtaagatttgggtacc

SEQ ID NO: 2959 - DNA, 445 bp, Homo sapiens
cagcaggctggcctatgtggtctaaggttcagcctgaaactcatagacactgatctggctgcagttttgctatctgggctgtgggcaagcctaagggatcctgcctgcccctaccctggacttgcctctgcacaccctccagagacaacaggtaaaacagggccacatagatgctgatggagccttcccaagttgtgcttgagccaggaggcctgctagggttaggaggtccttaggcctctgagaagctctgaagaactctctggaagcccctgggcccagtacctagctggctctgtgagggtgctgactggcttcagcaagttagaactagccaaaccaggaccctgtccaatctttgacaattgggagctgccaagagtgaagggaagagacagcccaggatactggcacagaggtagtctcactgcttgaactaggctga

SEQ ID NO: 2960 - DNA, 32 bp, Homo sapiens
gtgagcacttccaaatgcagctgcgctcttag

SEQ ID NO: 2961 - DNA, 136 bp, Homo sapiens
ccctgatggtgctatcgacaaggtgttaagtgagaaggtgattatctttggcatgggcaagcggaagtgtatcggtgagaccattgcccgctgggaggtctttctcttcctggctatcctgctgcaacgggtggaa

SEQ ID NO: 2962 - DNA, 76 bp, Homo sapiens
acacaagtttgaaaggcttttacatccccaaggggcgttgtgtctttgtaaaccagtggcagatcaaccatgacca

SEQ ID NO: 2963 - DNA, 25 bp, Homo sapiens
tcatcctggagaccttccgacactc

SEQ ID NO: 2964 - DNA, 66 bp, Homo sapiens
gtttgacacagtcacaactgctatctcctggagcctcatgtatttggtgatgaaccccagggtaca

SEQ ID NO: 2965 - DNA, 77 bp, Homo sapiens
aagcagctggatgagaacgccaatgtccagctgtcagatgagaagatcattaacatcgtcttggacctctttggagc

SEQ ID NO: 2966 - DNA, 389 bp, Homo sapiens
tggcctctgattgggcacatgctgaccctgggaaagaacccgcacctggcactgtcaaggatgagccagcagtatggggacgtgctgcagatccgaattggctccacacccgtggtggtgctgagcggcctggacaccatccggcaggccctggtgcggcagggcgatgatttcaagggccggcccgacctctacaccttcaccctcatcagtaatggtcagagcatgtccttcagcccagactctggaccagtgtgggctgcccgccggcgcctggcccagaatggcctgaaaagtttctccattgcctctgacccagcctcctcaacctcctgctacctggaagagcatgtgagcaaggaggctgaggtcctgataagcacgttgca

SEQ ID NO: 2967 - DNA, 69 bp, Homo sapiens
atgtcggccacggagtttcttctggcctctgtcatcttctgtctggtattctgggtaatcagggcctca

SEQ ID NO: 2968 - DNA, 25 bp, Homo sapiens
cacctccaagatccctacactgatc

SEQ ID NO: 2969 - DNA, 31 bp, Homo sapiens
gtgatcccaggctccaagagtccacccttcc

SEQ ID NO: 2970 - DNA, 44 bp, Homo sapiens
ggaggcgtggccacacgtacaagcccgcctataaaggtggcagt

SEQ ID NO: 2971 - DNA, 93 bp, Homo sapiens
cagtgtcaccaacactcggccgccgccgccagcttggcgcgcaccgccgcctccgccaccgccgacagcgcgcatcctccgtgtccccgctcc

SEQ ID NO: 2972 - DNA, 105 bp, Homo sapiens
atcaccagttatccatgctgctgcatataaacccagcttatttatttaaactgctgcatggattcccgccgtggataatgcctaccgatgggaatttaggtgaca

SEQ ID NO: 2973 - DNA, 110 bp, Homo sapiens
tgaagggcctgcatcggctgcagaagggccccggctacacgtacaaggagctgctggtgtggtactgcgacaacaccaacacccacggccccaagcgcatcatctgtgag

SEQ ID NO: 2974 - DNA, 65 bp, Homo sapiens
gtctccctctccgtaggcttcaagaccatggacttccctgccgtcaccatctgcaatgctagccc

SEQ ID NO: 2975 - DNA, 179 bp, Homo sapiens
atgccaatgccaccaggaacctgaacttctccatctggaaccacacacccctggtccttattgatgaacggaacccccaccaccccatggtccttgatctctttggagacaaccacaatggcttaacaagcagctcagcatcagaaaagatctgtaatgcccacgggtgcaaaatggcc

SEQ ID NO: 2976 - DNA, 88 bp, Homo sapiens
gtggtccctgggcacatatcaagcaatgggccccacccagtgaggctgatgggtgtttcttttctgtagtaatttgagtctcgctggg

SEQ ID NO: 2977 - DNA, 30 bp, Homo sapiens
cggaacttcaccagtgctacccaggcattg

SEQ ID NO: 2978 - DNA, 87 bp, Homo sapiens
caggtgccacagcaggagctagtagagatgagctaccccggcgagcagatgatcctggcctgcctattcggagctgagccctgcaac

SEQ ID NO: 2979 - DNA, 87 bp, Homo sapiens
acttcacgtccatcttctaccctcactatggcaactgttacatcttcaactggggcatgacagagaaggcacttccttcggccaacc

SEQ ID NO: 2980 - DNA, 108 bp, Homo sapiens
ttccttgcgtccacggccggggtcaggctgatgcttcacgagcagaggtcataccccttcatcagagatgagggcatctacgccatgtcggggacagagacgtccatc

SEQ ID NO: 2981 - DNA, 102 bp, Homo sapiens
caagcttcagcgcatgggggagccctacagcccgtgcaccgtgaatggttctgaggtccccgtccaaaacttctacagtgactacaacacgacctactccat

SEQ ID NO: 2982 - DNA, 213 bp, Homo sapiens
gccaaggcctcagtactccgggagagctggccccagcaagtctggctctgctgggcctttgtaggttgccacggggcaccccgggcctgtgggaccagtcactttcctgggctctctcaccagggcctagggttggccacttctcatccccacattggcaggtgtacccctggggaagcccaggggattatggggatcttactctggggtttc

SEQ ID NO: 2983 - DNA, 96 bp, Homo sapiens
tgcttccaagaccacatgatccgtaactgcaactgtggccactacctgtacccactgccccgtggggagaaatactgcaacaaccgggacttccca

SEQ ID NO: 2984 - DNA, 42 bp, Homo sapiens
atgagcgtggcgcagagagagacctgcattggcatgtgcaag

SEQ ID NO: 2985 - DNA, 45 bp, Homo sapiens
gaagggaattgtcaagctcaacatctacttccaagaatttaacta

SEQ ID NO: 2986 - DNA, 147 bp, Homo sapiens
ggctgctctcgaatctgggtggccagtttggcttctggatggggggctctgtgctgtgcctcatcgagtttggggagatcatcatcgactttgtgtggatcaccatcatcaagctggtggccttggccaagagcctacggcagcggc

SEQ ID NO: 2987 - DNA, 427 bp, Homo sapiens
gccaagactgttgcccgaggcctcactgtatggtgccctctccaaagggtcgggagggtagctctccaggccagagcttgtgtccttcaacagagaggccagcggcaactggtccgttactggccaagggctctgtagaatcacggtgctggtacaggatgcaggaataaattgtatcttcacctggttcctaccctcgtccctacctgtcctgatcctggtcctgaagacccctcggaacaccctctcctggtggcaggccacttccctcccagtgccagtctccatccaccccagagaggaacaggcgggtgggccatgtggttttctccttcctggccttggctggcctctggggcaggggtggtggagagatggaagggcatcaggtgtagggaccctgccaagtggcacctgatttactcta

SEQ ID NO: 2988 - DNA, 157 bp, Homo sapiens
tagctggctgatgggccactaaaacccccaaatattggccacataacttctgccatgtgcgaggggtagggggtaagtgtaatgaaagggtcaaggcttggggtctggggttagaccacctagactcaaatcctggctccatcttacaagctgtgtg

SEQ ID NO: 2989 - DNA, 117 bp, Homo sapiens
ttatagttgctgtaacctgcccagagaggttaagtaacatctctgaagtcacacagttggtgagtggcagagctagcagtctgggccaggcccaccccgcatcactctattgcctca

SEQ ID NO: 2990 - DNA, 218 bp, Homo sapiens
gcaagccagatagctacagtaatcgacagacagacaaacaagagcatcgtatgacccaggggccaacaagtcccaccccagtgacaccatctcacttttgcagagctcttgctcgcaaagtgcagctaggagaacccaggcctcctgatgacaaatgctccttctttctgccccccacgtgccaagagcgaggagggaagatagctgctggctcactg

SEQ ID NO: 2991 - DNA, 184 bp, Homo sapiens
cttgtttccgctgcatccagacttcctcaggcggtggctggaggctgcgcatctggggctttaaacatacaaagggattgccaggacctgcggcggcggcggcggcggcgggggctggggcgcgggggccggaccatgagccgctgagccgggcaaaccccaggccaccgagccagcggaccct

SEQ ID NO: 2992 - DNA, 109 bp, Homo sapiens
acgggtcccctgagggcgctctgtctcctgggctgcctgctgagccacgccgccgccgcgccgtcgcccatcatcaagttccccggcgatgtcgcccccaaaacggaca

SEQ ID NO: 2993 - DNA, 105 bp, Homo sapiens
gctgaaggacacactaaagaagatgcagaagttctttggactgccccagacaggtgatcttgaccagaataccatcgagaccatgcggaagccacgctgcggcaa

SEQ ID NO: 2994 - DNA, 51 bp, Homo sapiens
agcatggcgatggatacccctttgacggtaaggacggactcctggctcatg

SEQ ID NO: 2995 - DNA, 42 bp, Homo sapiens
ggagactcccattttgatgacgatgagctatggaccttggga

SEQ ID NO: 2996 - DNA, 143 bp, Homo sapiens
ccgatggggagtactgcaagttccccttcttgttcaatggcaaggagtacaacagctgcactgataccggccgcagcgatggcttcctctggtgctccaccacctacaactttgagaaggatggcaagtacggcttctgtccc

SEQ ID NO: 2997 - DNA, 596 bp, Homo sapiens
ccggtagggattacatgtggcgttaacccttccctgtgtcacccctctgataggaacagaaagctttggtgatagttagatgtggaaacagctgtatttcataaatttgggaagggttattccctgcattggacattagccatttactttgtgcttagccagatgcaagtacgcacaacacgcacgtgtctgggtctcgaggcagagattgttgttactcagcccctgctgatggctgagtcagtgtctgattcttgccatccttgtcaggggaatttgggaggagacaggggcttcctgggtggtagaaatgagaggtcagaggcagggggctggcattggtcgaagttaacgctttgcctttctcaactctgaggccactaaggtatctggactcagtcttgccttttctctaggtgccattgtttctggcattgcaggacaaggtcttttggtagagaggggagtggtgaggatacagggcctcgagttctgtggtgggaggccagggactgggctccattccggccatggtggagttaacgggggctggtgaggtcacctctggcgccgttgtgcacagatggtccttgtta

SEQ ID NO: 2998 - DNA, 107 bp, Homo sapiens
tgcaagtttccattccgcttccagggcacatcctatgacagctgcaccactgagggccgcacggatggctaccgctggtgcggcaccactgaggactacgaccgcga

SEQ ID NO: 2999 - DNA, 51 bp, Homo sapiens
gtgggtgccactccctctccctccctcagggcccagcacctgctgtctgac

SEQ ID NO: 3000 - DNA, 87 bp, Homo sapiens
tgggcaacaaatatgagagctgcaccagcgccggccgcagtgacggaaagatgtggtgtgcgaccacagccaactacgatgatgacc

SEQ ID NO: 3001 - DNA, 120 bp, Homo sapiens
ggtacagcctgttcctcgtggcagcccacgagtttggccacgccatggggctggagcactcccaagaccctggggccctgatggcacccatttacacctacaccaagaacttccgtctgt

SEQ ID NO: 3002 - DNA, 74 bp, Homo sapiens
tgtcactcctgagatctgcaaacaggacattgtatttgatggcatcgctcagatccgtggtgagatcttcttct

SEQ ID NO: 3003 - DNA, 91 bp, Homo sapiens
gtgacgccacgtgacaagcccatggggcccctgctggtggccacattctggcctgagctcccggaaaagattgatgcggtatacgaggccc

SEQ ID NO: 3004 - DNA, 70 bp, Homo sapiens
cctggagcgagggtaccccaagccactgaccagcctgggactgccccctgatgtccagcgagtggatgcc

SEQ ID NO: 3005 - DNA, 55 bp, Homo sapiens
ccaagctcatcgcagatgcctggaatgccatccccgataacctggatgccgtcgt

SEQ ID NO: 3006 - DNA, 93 bp, Homo sapiens
cttcttcaagggtgcctattacctgaagctggagaaccaaagtctgaagagcgtgaagtttggaagcatcaaatccgactggctaggctgctg

SEQ ID NO: 3007 - DNA, 104 bp, Homo sapiens
actgccttcgatacaccgggcctggagaactagagaaggacccggaggggcctggcagccgtgccttcagctctacagctaatcagcattctcactcctacctg

SEQ ID NO: 3008 - DNA, 312 bp, Homo sapiens
tagatgctgactgtactcctcccaggcgccccttccccctccaatcccaccaaccctcagagccacccctaaagagatactttgatattttcaacgcagccctgctttgggctgccctggtgctgccacacttcaggctcttctcctttcacaaccttctgtggctcacagaacccttggagccaatggagactgtctcaagagggcactggtggcccgacagcctggcacagggcagtgggacagggcatggccaggtggccactccagacccctggcttttcactgctggctgccttagaacctttctta

SEQ ID NO: 3009 - DNA, 122 bp, Homo sapiens
gtctgaagtcactgcacagtgcatctcagcccacatagtgatggttcccctgttcactctacttagcatgtccctaccgagtctcttctccactggatggaggaaaaccaagccgtggcttc

SEQ ID NO: 3010 - DNA, 34 bp, Homo sapiens
ccttcaaccattccccatgggaaatgtcaacaag

SEQ ID NO: 3011 - DNA, 213 bp, Homo sapiens
agacccagccagaagcggaaacttaaaaagtccgaatctctgctccctgcagggcacaggtgatggtgtctgctggaaaggtcagagcttccaaagtaaacagcaagagaacctcagggagagtaagctctagtccctctgtcctgtagaaagagccctgaagaatcagcaattttgttgctttattgtggcatctgttcgaggtttgcttcc

SEQ ID NO: 3012 - DNA, 32 bp, Homo sapiens
gctcctgtgccagctcctgcaagtgcaaagag

SEQ ID NO: 3013 - DNA, 34 bp, Homo sapiens
tgcaaaggggcgtcggagaagtgcagctgctgtg

SEQ ID NO: 3014 - DNA, 28 bp, Homo sapiens
gtggggacagccctgctcccagatgtaa

SEQ ID NO: 3015 - DNA, 27 bp, Homo sapiens
tttcatacaaccctgagcatttgctac

SEQ ID NO: 3016 - DNA, 296 bp, Homo sapiens
gacttcgggaacaccgcgtacctgcgggggcacagccccacccgagcgaacgggctccaaaggggaggtcccgcggtgcccaccgcgcagagctcagggggtggtgcgcccggcccttctgcggcgcacagcccagcccaggaacgcgggcggtgcggactcagcgggccgggtgcaggcgcggagctgggcctctgcgcccggcccgacctccgtctataaatagagcagccagttgcagggctccattctgctttccaactgcctgactgcttgttcgtctcactggtgtgagc

SEQ ID NO: 3017 - DNA, 40 bp, Homo sapiens
tggctcctgcacgtgcgccggctcctgcaagtgcaaagag

SEQ ID NO: 3018 - DNA, 63 bp, Homo sapiens
ccctcattgcccgtgtcattccctctccaggctttctgccctaaattcagatggggcaggaca

SEQ ID NO: 3019 - DNA, 42 bp, Homo sapiens
cagggaggtgcccggtcaagtctactgccacctctcactctc

SEQ ID NO: 3020 - DNA, 29 bp, Homo sapiens
ctgcgtctgcaaaggggcatcggagaagt

SEQ ID NO: 3021 - DNA, 25 bp, Homo sapiens
tgtgggaacagctcttctcccagat

SEQ ID NO: 3022 - DNA, 95 bp, Homo sapiens
taaatagaacaacctgcacaacctggatttttttaaaaatacaacactgagccatttgctgcatttctttttatactaaatatgtgactgacaat

SEQ ID NO: 3023 - DNA, 40 bp, Homo sapiens; identical to SEQ ID NO: 3017

SEQ ID NO: 3024 - DNA, 99 bp, Homo sapiens
agtggcgtcggaactgcaaagcacctgtgagcttgcggaagtcagttcagactccagcccgctccagcccggcccgacccgaccgcacccggcgcctgc

SEQ ID NO: 3025 - DNA, 40 bp, Homo sapiens
atgggcccttggagccgcagcctctcggcgctgctgctgc

SEQ ID NO: 3026 - DNA, 74 bp, Homo sapiens
gccaccctggctttgacgccgagagctacacgttcacggtgccccggcgccacctggagagaggccgcgtcctg

SEQ ID NO: 3027 - DNA, 25 bp, Homo sapiens
cctggttagtactagtacttggatg

SEQ ID NO: 3028 - DNA, 177 bp, Homo sapiens
gcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacag

SEQ ID NO: 3029 - DNA, 30 bp, Homo sapiens
ctggaatccaagcagaattgctcacatttc

SEQ ID NO: 3030 - DNA, 28 bp, Homo sapiens
aagagagactgggttattcctcccatca

SEQ ID NO: 3031 - DNA, 126 bp, Homo sapiens
gaaggcaaggttttctacagcatcactggccaaggagctgacacaccccctgttggtgtctttattattgaaagagaaacaggatggctgaaggtgacagagcctctggatagagaacgcattgcc

SEQ ID NO: 3032 - DNA, 99 bp, Homo sapiens
ctcacgctgtgtcatccaacgggaatgcagttgaggatccaatggagattttgatcacggtaaccgatcagaatgacaacaagcccgaattcacccagg

SEQ ID NO: 3033 - DNA, 65 bp, Homo sapiens
agacgcggacgatgatgtgaacacctacaatgccgccatcgcttacaccatcctcagccaagatc

SEQ ID NO: 3034 - DNA, 29 bp, Homo sapiens
ctgacttggttgtgtcgatctctctgcag

SEQ ID NO: 3035 - DNA, 86 bp, Homo sapiens
ccttcaaggtgaggggttaagcacaacagcaacagctgtgatcacagtcactgacaccaacgataatcctccgatcttcaatccca

SEQ ID NO: 3036 - DNA, 139 bp, Homo sapiens
cgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttg

SEQ ID NO: 3037 - DNA, 27 bp, Homo sapiens
ctcacagctgttcatacccttgtcccc

SEQ ID NO: 3038 - DNA, 194 bp, Homo sapiens
tttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatccta

SEQ ID NO: 3039 - DNA, 96 bp, Homo sapiens
ctggctggagattaatccggacactggtgccatttccactcgggctgagctggacagggaggattttgagcacgtgaagaacagcacgtacacagc

SEQ ID NO: 3040 - DNA, 203 bp, Homo sapiens
gttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattca

SEQ ID NO: 3041 - DNA, 321 bp, Homo sapiens
actattctaccgaggtggaggcagctgtcaactgcctggtcaatttgcatatatgggcttcctacacctacttctctctgggcttctatttccaccatgacgatgtggatctggaaggtgtgcaccacttcttccacaaattggccaaggagaagcacaagggcgctgagtgtcccttgaaaatgcaaaaccagtgtggcggccgcactgtcttcccggacatccagaagccatgtaaagatgaatggggtaaaaccctgggtgcgatggaagtcactctggccctggagaagaacctgaactggacccttttggatcttc

SEQ ID NO: 3042 - DNA, 29 bp, Homo sapiens
cccaagaatctatcattttgaagccaaag

SEQ ID NO: 3043 - DNA, 127 bp, Homo sapiens
ggtgggtgactacaaaatcaatctcaagctcatggataaccagaataaagaccaagtgaccaccttagaggtcagcgtgtgtgactgtgaaggggccgctggcgtctgtaggaaggcacagcctgtc

SEQ ID NO: 3044 - DNA, 94 bp, Homo sapiens
tcttgctgtttcttcggaggagagcggtggtcaaagagcccttactgcccccagaggatgacacccgggacaacgtttattactatgatgaaga

SEQ ID NO: 3045 - DNA, 99 bp, Homo sapiens
acgctcggcctgaagtgactcgtaacgacgttgcaccaaccctcatgagtgtcccccggtatcttccccgccctgccaatcccgatgaaattggaaatt

SEQ ID NO: 3046 - DNA, 143 bp, Homo sapiens
cccgccttatgattctctgctcgtgtttgactatgaaggaagcggttccgaagctgctagtctgagctccctgaactcctcagagtcagacaaagaccaggactatgactacttgaacgaatggggcaatcgcttcaagaagc

SEQ ID NO: 3047 - DNA, 1165 bp, Homo sapiens
tcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgccttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttc

SEQ ID NO: 3048 - DNA, 807 bp, Homo sapiens
tctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcacacaaggaatataaaaaccaccaccctccagcctgggcaacgtagtaaaacctcatctatacaagaatttaaaaataagctgggcgtggtggtacacacctgtggtcccagctactagggaggctgagccaggaagaacgctccagcccaggacttcgaggctgcaatgagctataattgcatcattgcactccagcctgggcaacagagaccctgtctcaaccaccaccaccaccaccacccctactacccctgtattcaaggtaaaaattgaagtttgtatgatgtaagagatgagaaaaacccaacaggaaacacagacacatcctccagttctatcaatggattgtgcagacactgagtttttagaaaaacatatccacggtaaccggtccctggcaattctgtttacatgaaatggggagaaagtcaccgaaatgggtgccgccggcccccactcccaattcattccctaacctgcaaacctttccaacttctcacgtcaggcctttgagaattctttccccctctcctggtttccacacctcagacacgcacagttcaccaagtgccttctgtagtcacatgaattgaaaaggagacgctgctcccacggaggggagcaggaatgctgcactgtttacaccctgactg

SEQ ID NO: 3049 - DNA, 90 bp, Homo sapiens
aaggtctggaggacgtagagttattgaaaatgcagatggttctgaggaggaaacggacactcgagacgcagacttcaatggaaccaaggc

SEQ ID NO: 3050 - DNA, 25 bp, Homo sapiens
acgagacctctttcgttccttctag

SEQ ID NO: 3051 - DNA, 26 bp, Homo sapiens
cccccccacaggaaacttcgcagtga

SEQ ID NO: 3052 - DNA, 109 bp, Homo sapiens
ggaggagtcccagcgcatcaacgccaaccgcaggaagctgcagcgggagctggatgaggccacggagagcaacgaggccatgggccgcgaggtgaacgcactcaagagc

SEQ ID NO: 3053 - DNA, 94 bp, Homo sapiens
ggcggccaccaagtcgctgaagcagaaagacaagaagctgaaggaaatcttgctgcaggtggaggacgagcgcaagatggccgagcagtacaag

SEQ ID NO: 3054 - DNA, 150 bp, Homo sapiens
gcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctgg

SEQ ID NO: 3055 - DNA, 55 bp, Homo sapiens
agctctgaccttatccagtgagcccttggtgatgtcactgagcactagttccatg

SEQ ID NO: 3056 - DNA, 32 bp, Homo sapiens
gtgcaggccctggattgagggacaagagggtg

SEQ ID NO: 3057 - DNA, 39 bp, Homo sapiens
aggatcctgcaccagtcaacacacgcgtggcggcttcct

SEQ ID NO: 3058 - DNA, 37 bp, Homo sapiens
aggccatgagcgaccgggtccgcaaagccacacagca

SEQ ID NO: 3059 - DNA, 27 bp, Homo sapiens
gaacgcactccaggacgagaagcgccg

SEQ ID NO: 3060 - DNA, 46 bp, Homo sapiens
ccgctgagagggctcgcaaacaagcggacctcgagaaggaggaact

SEQ ID NO: 3061 - DNA, 37 bp, Homo sapiens
ggaagatgcccgtgcctccagagatgagatctttgcc

SEQ ID NO: 3062 - DNA, 66 bp, Homo sapiens
gagcttcaggccgactctgccatcaaggggagggaggaagccatcaagcagctacgcaaactgcag

SEQ ID NO: 3063 - DNA, 82 bp, Homo sapiens
gccaaactgcggctggaagtcaacatgcaggcgctcaagggccagttcgaaagggatctccaagcccgggacgagcagaatg

SEQ ID NO: 3064 - DNA, 31 bp, Homo sapiens
ttgagcctcatagaatggggctgcccgctct

SEQ ID NO: 3065 - DNA, 186 bp, Homo sapiens
tctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggca

SEQ ID NO: 3066 - DNA, 182 bp, Homo sapiens
ttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtg

SEQ ID NO: 3067 - DNA, 53 bp, Homo sapiens
tgcttcaagaagaaacccggcagaagctcaacgtgtctacgaagctgcgccag

SEQ ID NO: 3068 - DNA, 78 bp, Homo sapiens
tgagagcgtcacagggatgcttaacgaggccgaggggaaggccattaagctggccaaggacgtggcgtccctcagttc

SEQ ID NO: 3069 - DNA, 104 bp, Homo sapiens
tgaacacctcaagtactagcccatgtgttttgagtaaaaagggctcctttcaacgaggatccccttctagaggctttgactaaccagtctcttggcacccttag

SEQ ID NO: 3070 - DNA, 91 bp, Homo sapiens
aggtgacggtgctgaagaaggccctggatgaagagacgcggtcccatgaggctcaggtccaggagatgaggcagaaacacgcacaggcggt

SEQ ID NO: 3071 - DNA, 55 bp, Homo sapiens
aaagcagaagcgagacctcggcgaggagctggaggccctaaagacagagctggaa

SEQ ID NO: 3072 - DNA, 79 bp, Homo sapiens
gctgaaacggaagctggagggtgatgccagcgacttccacgagcagatcgctgacctccaggcgcagatcgcagagctc

SEQ ID NO: 3073 - DNA, 31 bp, Homo sapiens
gaaaaggccaagaatcttaccaagctgaaaa

SEQ ID NO: 3074 - DNA, 46 bp, Homo sapiens
ctccttgaggagaggattagtgacttaacgacaaatcttgcagaag

SEQ ID NO: 3075 - DNA, 39 bp, Homo sapiens
ctgcaacttgagaaggtcacggctgaggccaagatcaag

SEQ ID NO: 3076 - DNA, 178 bp, Homo sapiens
ggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaag

SEQ ID NO: 3077 - DNA, 27 bp, Homo sapiens
gagaatgagcttaaggagctggaacag

SEQ ID NO: 3078 - DNA, 48 bp, Homo sapiens
gcagctgaccgccatgaaggtgattcagaggaactgcgccgcctacct

SEQ ID NO: 3079 - DNA, 106 bp, Homo sapiens
agcaaaatcttcttccgaactggcgtcctggcccacctagaggaggagcgagatttgaagatcaccgatgtcatcatggccttccaggcgatgtgtcgtggctact

SEQ ID NO: 3080 - DNA, 77 bp, Homo sapiens
caagctggatgcgttcctggtgctggagcagctgcggtgcaatggggtgctggaaggcattcgcatctgccggcagg

SEQ ID NO: 3081 - DNA, 229 bp, Homo sapiens
aggaagtattcactgggctctgccctgtcctgggtgctggggagcagtgttagaaaaattgtagcccttccctgtgggtttctcataatctggtgcaggcatcttcagcttggggcgattgtgtcctctatatggacatgctacagacatttttggttgtcacaaccaggagggggctgttagtcagcatctagtgggtaggggccagggatgccctaagcattgtaca

SEQ ID NO: 3082 - DNA, 145 bp, Homo sapiens
cctggaccagatggccaagatgacggagagctcgctgcccagcgcctccaagaccaagaagggcatgttccgcacagtggggcagctgtacaaggagcagctgggcaagctgatgaccacgctacgcaacaccacgcccaacttc

SEQ ID NO: 3083 - DNA, 88 bp, Homo sapiens
ctataatgcgagtgcctggctgaccaagaatatggacccgctgaatgacaacgtgacttccctgctcaatgcctcctccgacaagttt

SEQ ID NO: 3084 - DNA, 110 bp, Homo sapiens
acggacaagtctttcgtggagaagctgtgcacggagcagggcagccaccccaagttccagaagcccaagcagctcaaggacaagactgagttctccatcatccattatgc

SEQ ID NO: 3085 - DNA, 26 bp, Homo sapiens
ggctggacctacagccctgcatcgag

SEQ ID NO: 3086 - DNA, 121 bp, Homo sapiens
tttggccaaggcaacatatgagcgccttttccgctggatactcacccgcgtgaacaaagccctggacaagacccatcggcaaggggcttccttcctggggatcctggatatagctggattt

SEQ ID NO: 3087 - DNA, 90 bp, Homo sapiens
tgctcagaaagtttgccacctcatgggaattaatgtgacagatttcaccagatccatcctcactcctcgtatcaaggttgggcgagatgt

SEQ ID NO: 3088 - DNA, 29 bp, Homo sapiens
tgaaggtggtatcatcggtcctgcagctt

SEQ ID NO: 3089 - DNA, 123 bp, Homo sapiens
ggagggcttcaacaactacaccttcctctccaatggctttgtgcccatcccagcagcccaggatgatgagatgttccaggaaaccgtggaggccatggcaatcatgggtttcagcgaggagga

SEQ ID NO: 3090 - DNA, 39 bp, Homo sapiens
ctgctagaaaaatcacgggcaattcgccaagccagagac

SEQ ID NO: 3091 - DNA, 26 bp, Homo sapiens
catccgcatcaacttcgacgtcacgg

SEQ ID NO: 3092 - DNA, 75 bp, Homo sapiens
aagcagcttctacaagcaaacccgattctggaggctttcggcaacgccaaaacagtgaagaacgacaactcctca

SEQ ID NO: 3093 - DNA, 760 bp, Homo sapiens
ggcccaactgcagccgccatgttttagggctaggccaagagcagctcgtttgctttcccagcttaacttaccacattggccctttcctgccatgattaatcacgtgaccgcgtttgtgcaaaggcatcccggcagagggggccggtgggctgtgtacagtctcagcttcctttaacccaatgaatggagctcaggcaacctgctttgaagctttattccgcagtccgctaagaggattcctggtgggttttgtgcattccttacttgtctgctgtagaagacttcagaaaaccagtcctgagaaagaaaaaattgcaacttaaaaaaaattgcactaaaataattagaaggaggcttgtagtggtttaacttgaagaaggctgcttgttaaacatgaacagcagcacgactgccatgtacagtgggacaggtggtgcactgcacaactccggggggcaccattcatcatgatgtaaatgacatcaccgacattgtgcaaggcagtggctttgagtggcagtgatgttgcacagatgagcaggccctggtcttgaaaaaagtgaccttcctagggagcagatgtcctagctattagagagctcagacagttgcttctcttctgaaatcctcctgtaaatctgaacattagcatcagggtctaagaggaggtaggagataggagagaacctgtgggttaagggcagagttttgtgacaacatccatccaaggtagaactgtcaggacctaggttgctttctc

SEQ ID NO: 3094 - DNA, 373 bp, Homo sapiens
tccagtgttcgccattccagatgtcactttgcgtcctcagaggggactctggggcagccaccatggccggcttgtctggaggcccttggagatctaggatgggcgctggtcgtggctttggagaactttccttctccaaacaaatgcaggaaactcaagattcagcatcctagaattgtctctggcaagttggtttccagccatagtgagtgggaacaatggccccagaggctgtgtggcagtttaaacacagtttccactgccttccctttccctaaagagtaaacacaggagataatactttctaacaactcatcgttatcaagggcctactatgtgctgcttgttttggctgcatgcgtaaacacatctc

SEQ ID NO: 3095 - DNA, 230 bp, Homo sapiens
cagcttgcagcccaaccgagatacaaacagaacatcattgcaagaactcaggccccatctgactacccctcccctgaagactcaaagagggaccgtctttttggcgagcaggcctgttgagtgtgggtgatttcttggctcagctagaagcatccctccagaagggggcccgttttgtgaaatgagaataagccctttccttccatagcgagatcttcctccacgtcggg

SEQ ID NO: 3096 - DNA, 52 bp, Homo sapiens
aggtcattcagtacctggccgtggtggcctcctcccacaagggcaagaaaga

SEQ ID NO: 3097 - DNA, 178 bp, Homo sapiens
taaggtcacccaggtaactggcagaggagggatttgaacttgagcaacctggtcctggagcccattatgctattctgccaattgatgctataggggagagaggcgttgcttctgcctggggttttgcaggacgtgtaggagttgtacagtacaaaatgccagggtgctttgccagtca

SEQ ID NO: 3098 - DNA, 146 bp, Homo sapiens
gcctcttctgcgtggtggtcaacccctataaacacctgcccatctactcggagaagatcgtcgacatgtacaagggcaagaagaggcacgagatgccgcctcacatctacgccatcgcagacacggcctaccggagcatgcttcaa

SEQ ID NO: 3099 - DNA, 328 bp, Homo sapiens
cgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctc

SEQ ID NO: 3100 - DNA, 58 bp, Homo sapiens
gtcagatccgagctcgccatccagtttcctctccactagtccccccagttggagatct

SEQ ID NO: 3101 - DNA, 28 bp, Homo sapiens
tggactgtattttgatgcaacaacaaag

SEQ ID NO: 3102 - DNA, 636 bp, Homo sapiens
acggtcctctcaagtgtctattagataggcaataagaactgcagtgtagctgagtaacatcttttagctgactataaatcactttgtttttaaacaagaaaagctgtgctcttttatgtgatgccttttttatttattcaggctatacctacaatatgtgaatcaaactgtttaatgaatcctgggacatactgatgactataaactggcctctctgagtcatagaaaaatggccttatttctccagaagtgagtaaaccacacttccaggctatctgaactcctgaagccctaaaaataaaaagcacagttgtaactacctgaaatatgaagatccagtttcatacaaacatttgtatgacgtgaatagttgatggcatttttttgtcatgaaaaaaataatgtaaatcacagacttttgccaaagctcttattttttttcctaaatctctccagaaaaaaaatgcaagtgactaaattcaattattgactaatttccactttttatccatgacttctccaaatcaaaccacagtatatgttgtaacaatatctatgaccactgttagcccattatattcattccaattagaagaaatgtgaatactatattccgtgttttgagtgacaagtttc

SEQ ID NO: 3103 - DNA, 89 bp, Homo sapiens
ccatccctgccatcgggagcccccagccagcctctcagcagcaccagtcgcaaatacagtctcagacacagactcaagtattatcgcag

SEQ ID NO: 3104 - DNA, 27 bp, Homo sapiens
caccagtctcagccttctcctcggcag

SEQ ID NO: 3105 - DNA, 117 bp, Homo sapiens
aatgcatcagcaaatccagcagcagatgcagcagcagcatttccagcaccacatgcagcagcacctgcagcagcagcagcagcatctccagcagcaaattaatcaacagcagctgca

SEQ ID NO: 3106 - DNA, 30 bp, Homo sapiens
agcagcatcagatgcaattgcagcagcagc

SEQ ID NO: 3107 - DNA, 253 bp, Homo sapiens
cagaccatccgttctgttcagcagaccctggcgtcgaccaatctaacatcctctctccttctcaacactccactgtctcaacatggaacagtgtcagcatcacctcagactctccagcaatccctccctaggtcaatcgctcccaaacccttaaccatgagactccccatgaaccagattgtcacatcagtcaccattgcagccaacatgccctcgaacattggggctccactgataagctccatgggaacga

SEQ ID NO: 3108 - DNA, 50 bp, Homo sapiens
aaagaatacctgaaggccctggcggcatacagggccagcctcgtttctaa

SEQ ID NO: 3109 - DNA, 645 bp, Homo sapiens
gtctcattattgtcaccgggcatttgaaattttattccaagttcattttaaagcaaggcagtatgagaggtattcagaaattagccatgcttgtgggagatacttccttaggggcttcgtctcctctccttccccttgcaactcctccacacaaatgaagggaagaatgggttccttgggggtcgatcccccccttactccttgcatgaaactccaattaccattaaaagaagttaacttttacatatccacagaagaatagatcaactcctatgagtgataaaatagaataattgttttcaagaatgaagagtggaaagtccttgattttgtttacaaatcatgaacttatttcaggaactcattcctagaagcttgttttgttgggaaggtgcaacattagaaatttctttttagtttgcactgagtttattactgtagatagcagactgattttctgtcccagaaatataattctgagggactggaaaagtgctgcacctaacttttaaactctggagagaaagatgcatgttgactgaacacccagccatcagaccacttaggaaaaggagaagcccaaatcatgtttaatatgctggaattttatttatgtaactcagtggggtcactaatggaaatctc

SEQ ID NO: 3110 - DNA, 112 bp, Homo sapiens
cagcatatgccctgtttttcagagacacacaggctgcaattaaaggtcaaaaccccaatgcaacctttggagaggtctcaaaaattgtagcatctatgtgggacagccttgg

SEQ ID NO: 3111 - DNA, 176 bp, Homo sapiens
acacaagtgtcccagtaccggcaggatccctccctgatcatgcggtccatcgtccacatgaccgatgctgcgcgttctggggtcatgcctcctgcccagctcaccaccatcaaccagtctcagctcagcgcccagttggggttgaatttgggaggtgccagtatgcctcacacatc

SEQ ID NO: 3112 - DNA, 146 bp, Homo sapiens
ctttcaagccctcagcgatccattgccttcccagggaagtgaattcacaccccagtttccccctcaaagcctggacctcccttccattacaatctcaagaaatctcgtggaacaagatggcgtgcttcatagcagtgggttgcata

SEQ ID NO: 3113 - DNA, 32 bp, Homo sapiens
tggggacgaggaattcgaaattccaccaatca

SEQ ID NO: 3114 - DNA, 34 bp, Homo sapiens
atggctgaggcgaacaatgcgttcttcgctgcca

SEQ ID NO: 3115 - DNA, 94 bp, Homo sapiens
gctagaatctgtgttgttcattgcagtttgtgctcagccacggaaggcacctatccctagcacccaacccccatccacctagggctctataaaa

SEQ ID NO: 3116 - DNA, 94 bp, Homo sapiens
cttcggcatggatgtgaggttctaccccgcggcggccggggaccctgccagcctggacttcgcgcagtgcctggggtactacggctacagcaag

SEQ ID NO: 3117 - DNA, 196 bp, Homo sapiens
cgcgcgcagcgctgcctcggtgccccggcggggcgcgtccccccggccgcctcccgctctcccgcggctcgcgtggccgcgcctttgtgtgcggcggccgcggctcccgagctcctcgggctctgggtcccggcgcccctccggccgcgagtcccacgcgccacccccgggcgccctcgacggtggatctagcggc

SEQ ID NO: 3118 - DNA, 30 bp, Homo sapiens
cccttgccgtgatagcttgcaacaccttgg

SEQ ID NO: 3119 - DNA, 531 bp, Homo sapiens
ctggcccttgcaatcttctactttaaggtttgcagagataaaccaataaatccacaccgtacatctgcaatatgaattcaagaaaggaaatagtaccttcaatacttaaaaatagtcttccacaaaaaatactttatttctgatctatacaaattttcagaaggttattttctttatcattgctaaactgatgacttactatgggatggggtccagtcccatgaccttggggtacaattgtaaacctagagttttatcaactttggtgaacagttttggcataatagtcaatttctacttctggaagtcatctcattccactgttggtattatataattcaaggagaatatgataaaacactgccctcttgtggtgcattgaaagaagagatgagaaatgatgaaaaggttgcctgaaaaatgggagacagcctcttacttgccaagaaaatgaagggattggaccgagctggaaaacctcctttaccagatgctgactggcactggtggtttttgctctcgacagtatcc

SEQ ID NO: 3120 - DNA, 222 bp, Homo sapiens
ggtacagtttggctaggtatcattcaactctccaatgttctattaatcacctctctgtagtttatggcagaagggaattgctcagagaaggaaaagactgaatctacctgccctaagggacttaacttgtttggtagttagccatctaatgcttgtttatgatatttcttgctttcaattacaaagcagttactaatatgcctagcacaagtaccactcttg

SEQ ID NO: 3121 - DNA, 54 bp, Homo sapiens
aacatgttatcaaatctgggtatctttccaggcttccctgacttgctttagttt

SEQ ID NO: 3122 - DNA, 54 bp, Homo sapiens
tttctgtgggccatcacttgggcaagtccatcccaactgacaaccagatcaaag

SEQ ID NO: 3123 - DNA, 79 bp, Homo sapiens
tgtggcttccaagtcttagaacctcaactgacatatagcattgggcacactccagcagacgcccgaattcaaatcctgg

SEQ ID NO: 3124 - DNA, 90 bp, Homo sapiens
gtgctttccatcaccactggtggcagtggctccatgtactctctgcaagggatccacggggacatgaatgtcattctctggccaattcag

SEQ ID NO: 3125 - DNA, 75 bp, Homo sapiens
cattctgaaaggctggtttgagcgagtgttcataggagagtttgcttacacttacgctgccatgtatgacaaagg

SEQ ID NO: 3126 - DNA, 120 bp, Homo sapiens
gaccctgcgaactttcagtatcctgccgagtctgttctggcttataaagaaggccatctgagcccagatattgtggctgaacaaaagaagctggaagccgcagaccttgtgatattccag

SEQ ID NO: 3127 - DNA, 130 bp, Homo sapiens
agcactgatcgtactggctcactcagagaggacgtccttcaactatgccatgaaggaggctgctgcagcggctttgaagaagaaaggatgggaggtggtggagtcggacctctatgccatgaacttcaat

SEQ ID NO: 3128 - DNA, 114 bp, Homo sapiens
tcaaacgggccggacaggatatataagagagaatgcaccgtgcactacacacgcgactcccacaaggttgcagccggagccgcccagctcaccgagagcctagttccggccagg

SEQ ID NO: 3129 - DNA, 45 bp, Homo sapiens
ctggtgcagacagcctagctggactttgggtgaggcggttcagcc

SEQ ID NO: 3130 - DNA, 27 bp, Homo sapiens
ggctgtgcttttctcgggggccctgct

SEQ ID NO: 3131 - DNA, 38 bp, Homo sapiens
tttgctgccatccttcacggtgacacccacggttacag

SEQ ID NO: 3132 - DNA, 81 bp, Homo sapiens
taccaagagccacaaaaccaccactcacaggacaaccaccacaggcaccaccagccacggacccacgactgccactcacaa

SEQ ID NO: 3133 - DNA, 130 bp, Homo sapiens
agcaatagcactgccaccagccagggaccctcaactgccactcacagtcctgccaccactagtcatggaaatgccacggttcatccaacaagcaacagcactgccaccagcccaggattcaccagttctg

SEQ ID NO: 3134 - DNA, 27 bp, Homo sapiens
accacctccaccctctccgagtcctag

SEQ ID NO: 3135 - DNA, 96 bp, Homo sapiens
aggagaccattggagactacacgtggaccaatggttcccagccctgtgtccacctccaagcccagattcagattcgagtcatgtacacaacccagg

SEQ ID NO: 3136 - DNA, 89 bp, Homo sapiens
tctctgtactgaaccccaacaaaaccaaggtccagggaagctgtgagggtgcccatccccacctgcttctctcattcccctatggacac

SEQ ID NO: 3137 - DNA, 38 bp, Homo sapiens
agctacatggcggtggagtacaatgtgtccttccccca

SEQ ID NO: 3138 - DNA, 125 bp, Homo sapiens
agtggacattctcggctcagaatgcatcccttcgagatctccaagcacccctggggcagagcttcagttgcagcaactcgagcatcattctttcaccagctgtccacctcgacctgctctccctg

SEQ ID NO: 3139 - DNA, 235 bp, Homo sapiens
ccaggcccataagccactcatctctcttcttaaccccccaaatctcgctctcccagcttgtcatggctacagggcagctttctttccatcctctacaagactctgccagtttcccccttttatcactgctgagtcactgcggtgagctcctcaccaatctcctactccccagcatccccccattccctcctcccacctttatcccaaccagcacgtcactgcaaatacctacctg

SEQ ID NO: 3140 - DNA, 100 bp, Homo sapiens
cagtgaccggtccatcttgctgcctctcatcatcggcctgatccttcttggcctcctcgccctggtgcttattgctttctgcatcatccggagacgccca

SEQ ID NO: 3141 - DNA, 337 bp, Homo sapiens
ggtacccttatttcctcgacacgcaactggctcaaagacaatgttattttccttccctttcttgaagaacaaaaagaaagccgggcatgacggctcatgcctgtaatcccagcactttgggaggctgaggcaggtggatcactggaggtcaggagtttgagaccagcctggccaacatggtgaaaccctgtctctactaaaaatacaattagccaggtgtggcggcgtaatcccagctggcctgtaatcccagctacttgggaggctgaggcagaactgcttgaacccaggaggtggaggttgcagtgagccgtcatcgcgccactaagccaagatc

SEQ ID NO: 3142 - DNA, 114 bp, Homo sapiens
ttttattaaatgtgacgaactgccccccccccccccccagcaggagagcagcaaaatttatgcaaatctttgacggggttttccttgtcctgccaggattaaaagccatgagtt

SEQ ID NO: 3143 - DNA, 133 bp, Homo sapiens
ttcccggatttttgtgggcgcctgccccgcccctcgtccccctgctgtgtccatatatcgaggcgatagggttaagggaaggcggacgcctgatgggttaatgagcaaactgaagtgttttccatgatctttt

SEQ ID NO: 3144 - DNA, 60 bp, Homo sapiens
cgcaattgaagtaccacctcccgagggtgattgcttccccatgcggggtagaacctttgc

SEQ ID NO: 3145 - DNA, 194 bp, Homo sapiens
ccagtggtctatacctccagcagcaagtcgagtgagcaagtgatgtcctgaaaggcccagtggatcagtggaatgaagcgggcaggaagacttagtgctcctgaaacaaggaatccagaatccaggagaaggatggctcagtggggctttcaagggacaagtatgggggttgaaggggtcactgtccctatacc

SEQ ID NO: 3146 - DNA, 109 bp, Homo sapiens
ggcaaagcaaagctatattcaagaccacatgcaaagctactccctgagcaaagagtcacagataaaacgggggcaccagtagaatggccaggacaaacgcagtgcagca

SEQ ID NO: 3147 - DNA, 32 bp, Homo sapiens
gatgagagtgacatgtactgttgtggacatgc

SEQ ID NO: 3148 - DNA, 25 bp, Homo sapiens
tgccccgggggtcctggaagccaca

SEQ ID NO: 3149 - DNA, 108 bp, Homo sapiens
agaatgaagttgtgaagctgagattcccctccattgggaccggagaaaccaggggagccccccgggcagccgcgcgccccttcccacggggccctttactgcgccgcg

SEQ ID NO: 3150 - DNA, 26 bp, Homo sapiens
cagccggagccatggggccggagccg

SEQ ID NO: 3151 - DNA, 37 bp, Homo sapiens
gagctggcggccttgtgccgctgggggctcctcctcg

SEQ ID NO: 3152 - DNA, 141 bp, Homo sapiens
tgtgcaccggcacagacatgaagctgcggctccctgccagtcccgagacccacctggacatgctccgccacctctaccagggctgccaggtggtgcagggaaacctggaactcacctacctgcccaccaatgccagcctgt

SEQ ID NO: 3153 - DNA, 149 bp, Homo sapiens
ttgggagcagttgtgaagctcagaagagaaatgtctgtgaaaaggttatgaacaggagggagagtggaaaccaacctgctggatcgtgtccacagaccctggaatggggccacatgcttggtttgtcaaattgcagacgccggccgggt

SEQ ID NO: 3154 - DNA, 133 bp, Homo sapiens
cagggctacgtgctcatcgctcacaaccaagtgaggcaggtcccactgcagaggctgcggattgtgcgaggcacccagctctttgaggacaactatgccctggccgtgctagacaatggagacccgctgaaca

SEQ ID NO: 3155 - DNA, 32 bp, Homo sapiens
aggggaaagggtcctctgatcattgctcaccc

SEQ ID NO: 3156 - DNA, 118 bp, Homo sapiens
ggtcttgatccagcggaacccccagctctgctaccaggacacgattttgtggaaggacatcttccacaagaacaaccagctggctctcacactgatagacaccaaccgctctcgggcc

SEQ ID NO: 3157 - DNA, 52 bp, Homo sapiens
gccactgcccactgactgctgccatgagcagtgtgctgccggctgcacgggc

SEQ ID NO: 3158 - DNA, 74 bp, Homo sapiens
tggtcacctacaacacagacacgtttgagtccatgcccaatcccgagggccggtatacattcggcgccagctgt

SEQ ID NO: 3159 - DNA, 107 bp, Homo sapiens
acctttctacggacgtgggatcctgcaccctcgtctgccccctgcacaaccaagaggtgacagcagaggatggaacacagcggtgtgagaagtgcagcaagccctgt

SEQ ID NO: 3160 - DNA, 58 bp, Homo sapiens
tgcagttcctgtccctctgcgcatgcagcctggcccagcccaccctgtcctatccttc

SEQ ID NO: 3161 - DNA, 63 bp, Homo sapiens
tacaagtgtccctatatcccctgtcagtgtggggaggggcccggaccctgatgctcatgtggc

SEQ ID NO: 3162 - DNA, 82 bp, Homo sapiens
ggcatggagcacttgcgagaggtgagggcagttaccagtgccaatatccaggagtttgctggctgcaagaagatctttggga

SEQ ID NO: 3163 - DNA, 57 bp, Homo sapiens
aacactgccccgctccagccagagcagctccaagtgtttgagactctggaagagatc

SEQ ID NO: 3164 - DNA, 155 bp, Homo sapiens
ggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgca

SEQ ID NO: 3165 - DNA, 246 bp, Homo sapiens
agcagcgttcttggacttgtgcagactgcccgtctctgtgcacccttcttgactcagcacagctctggctggcttggcctcttggcatggcttctctagctgggtcctacctgccttggcatccttccctccccctctgtttctgaaatctcagaactcttcctctccctacatcggccccacctgtccccacccctccagcccacagccatgcccacagccagttccctggttcacttggacctg

SEQ ID NO: 3166 - DNA, 104 bp, Homo sapiens
gccaccagctgtgcgcccgagggcactgctggggtccagggcccacccagtgtgtcaactgcagccagttccttcggggccaggagtgcgtggaggaatgccga

SEQ ID NO: 3167 - DNA, 47 bp, Homo sapiens
tggctggaggggtgcatggggctcctctcagaccccctcaccactgt

SEQ ID NO: 3168 - DNA, 32 bp, Homo sapiens
gctccccagggagtatgtgaatgccaggcact

SEQ ID NO: 3169 - DNA, 223 bp, Homo sapiens
actcgctgttacaccttaggtaatgcgttttcctctctgggtgcctcccattttctggctcaagtccctgcccaggatcaagcttggaggagggccccgagggaggggccacagagactgggtgaagagcaagggtgtttgtcccaggagcatggcgaaaattgctgctgggtggccttgggaagcacaaaggggacccaactaagggcctgatcctactgcc

SEQ ID NO: 3170 - DNA, 119 bp, Homo sapiens
gtggcctgtgcccactataaggaccctcccttctgcgtggcccgctgccccagcggtgtgaaacctgacctctcctacatgcccatctggaagtttccagatgaggagggcgcatgcca

SEQ ID NO: 3171 - DNA, 75 bp, Homo sapiens
gtgagtccaacggtcttttctgcagaaaggaggactttcctttcaggggtctttctggggctcttactataaaag

SEQ ID NO: 3172 - DNA, 25 bp, Homo sapiens
gggctgccccgccgagcagagagcc

SEQ ID NO: 3173 - DNA, 164 bp, Homo sapiens
ttccactgtggaacctcctgtcattttccacttcaccaagtgacagaggacctgctcagatgctgaggggaggggactgcaaggaaagatggctaggaaacccagtccctccacaccctagagtaacttgatgccttgtgagggacacaggcaaagttcaattc

SEQ ID NO: 3174 - DNA, 73 bp, Homo sapiens
gtggtctttgggatcctcatcaagcgacggcagcagaagatccggaagtacacgatgcggagactgctgcagg

SEQ ID NO: 3175 - DNA, 81 bp, Homo sapiens
agcgatgcccaaccaggcgcagatgcggatcctgaaagagacggagctgaggaaggtgaaggtgcttggatctggcgcttt

SEQ ID NO: 3176 - DNA, 96 bp, Homo sapiens
gcatctggatccctgatggggagaatgtgaaaattccagtggccatcaaagtgttgagggaaaacacatcccccaaagccaacaaagaaatcttag

SEQ ID NO: 3177 - DNA, 135 bp, Homo sapiens
tgggcatctgcctgacatccacggtgcagctggtgacacagcttatgccctatggctgcctcttagaccatgtccgggaaaaccgcggacgcctgggctcccaggacctgctgaactggtgtatgcagattgcca

SEQ ID NO: 3178 - DNA, 118 bp, Homo sapiens
atgtgcggctcgtacacagggacttggccgctcggaacgtgctggtcaagagtcccaaccatgtcaaaattacagacttcgggctggctcggctgctggacattgacgagacagagta

SEQ ID NO: 3179 - DNA, 37 bp, Homo sapiens
ctgggtggagtggtgtctagcccatgggagaactctg

SEQ ID NO: 3180 - DNA, 41 bp, Homo sapiens
ctggagtccattctccgccggcggttcacccaccagagtga

SEQ ID NO: 3181 - DNA, 75 bp, Homo sapiens
actgtgtgggagctgatgacttttggggccaaaccttacgatgggatcccagcccgggagatccctgacctgctg

SEQ ID NO: 3182 - DNA, 31 bp, Homo sapiens
gtgcgtggctgagctgtgctggctgcctgga

SEQ ID NO: 3183 - DNA, 39 bp, Homo sapiens
gttggatgattgactctgaatgtcggccaagattccggg

SEQ ID NO: 3184 - DNA, 51 bp, Homo sapiens
gttggtgtctgaattctcccgcatggccagggacccccagcgctttgtggt

SEQ ID NO: 3185 - DNA, 44 bp, Homo sapiens
tctaccgctcactgctggaggacgatgacatgggggacctggtg

SEQ ID NO: 3186 - DNA, 228 bp, Homo sapiens
gtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctga

SEQ ID NO: 3187 - DNA, 32 bp, Homo sapiens
atgtgaaccagccagatgttcggccccagccc

SEQ ID NO: 3188 - DNA, 122 bp, Homo sapiens
agccttcgacaacctctattactgggaccaggacccaccagagcggggggctccacccagcaccttcaaagggacacctacggcagagaacccagagtacctgggtctggacgtgccagtgt

SEQ ID NO: 3189 - DNA, 25 bp, Homo sapiens
agaaggccaagtccgcagaagccct

SEQ ID NO: 3190 - DNA, 39 bp, Homo sapiens
cgaccacttccaggggaacctgccatgccaggaacctgt

SEQ ID NO: 3191 - DNA, 107 bp, Homo sapiens
cttcctgcttgagttcccagatggctggaaggggtccagcctcgttggaagaggaacagcactggggagtctttgtggattctgaggccctgcccaatgagactcta

SEQ ID NO: 3192 - DNA, 110 bp, Homo sapiens
ggtactgaaagccttagggaagctggcctgagaggggaagcggccctaagggagtgtctaagaacaaaagcgacccattcagagactgtccctgaaacctagtactgccc

SEQ ID NO: 3193 - DNA, 31 bp, Homo sapiens
agtatccaggctttgtacagagtgcttttct

SEQ ID NO: 3194 - DNA, 181 bp, Homo sapiens
cacaaggggctttttcatccttaggagacctgagtcctcaagaaaacccttttctggaagtatctgctccttcagaacattttatagaaaacaataatacaaaacacacaactgcaagaaatgcctttgaagaaaatgattttatggaaaacactaacatgccagaaggaaccatctctga

SEQ ID NO: 3195 - DNA, 31 bp, Homo sapiens
ggcttaccattaaagttctcaatgcaaccat

SEQ ID NO: 3196 - DNA, 143 bp, Homo sapiens
tctgaggcgctgctttgtcaaaaggaagtctctaggttctgagctctggctttgccttggctttgccagggctctgtgaccaggaaggaagtcagcatgcctctagaggcaaggaggggaggaacactgcactcttaagcttc

SEQ ID NO: 3197 - DNA, 41 bp, Homo sapiens
aatgggttcgggagtacatcaactctttggagatgagctag

SEQ ID NO: 3198 - DNA, 80 bp, Homo sapiens
ctttgcctacattgcccgcccactgccccgtgcccacatcaaggagtatttctacaccagtggcaagtgctccaacccag

SEQ ID NO: 3199 - DNA, 69 bp, Homo sapiens
atgaaggtctccgcggcagccctcgctgtcatcctcattgctactgccctctgcgctcctgcatctgcc

SEQ ID NO: 3200 - DNA, 36 bp, Homo sapiens
atcaagacagcacgtggacctcgcacagcctctccc

SEQ ID NO: 3201 - DNA, 185 bp, Homo sapiens
ggaaagtccttgcacagacaccagtgagtgagttctaaaagatacccttggaattatcagactcagaaacttttattttttttttctgtaacagtctcaccagacttctcataatgctcttaatatattgcacttttctaatcaaagtgcgagtttatgagggtaaagctctactttcctactgc

SEQ ID NO: 3202 - DNA, 26 bp, Homo sapiens
tgaatgaaatccaaaagcacgcatga

SEQ ID NO: 3203 - DNA, 33 bp, Homo sapiens
caggagaccatcaacggaagattagttctttgt

SEQ ID NO: 3204 - DNA, 30 bp, Homo sapiens
cacgggaagaatcaaagtcgagcatgaaag

SEQ ID NO: 3205 - DNA, 167 bp, Homo sapiens
agtctcggtactcctgcaagctccaggacatgcaagagatcatctcccactatgaggaggaactgacgcagctacgccatgaactggagcggcagaacaatgaataccaagtgctgctgggcatcaaaacccacctggagaaggaaatcaccacgtaccgacggctc

SEQ ID NO: 3206 - DNA, 41 bp, Homo sapiens
ggtgacatccacgaactgaagcgcacattccaggccctgga

SEQ ID NO: 3207 - DNA, 122 bp, Homo sapiens
caatgtcaatgtgaaggtggatacaggtcccagggaagatctgattaaggtcctggaggatatgagacaagaatatgagcttataataaagaagaagcatcgagacttggacacttggtata

SEQ ID NO: 3208 - DNA, 126 bp, Homo sapiens
cttggaaattgaagtcgagggcctccgaaggaccttagacaacctgaccattgtcacaacagacctagaacaggaggtggaaggaatgaggaaagagctcattctcatgaagaagcaccatgagca

SEQ ID NO: 3209 - DNA, 30 bp, Homo sapiens
ccaggatggcagtggatgacttcaacctca

SEQ ID NO: 3210 - DNA, 294 bp, Homo sapiens
agggctcccaccgtccatggcggtgcggggggagcccgcatctccctgtccttcaccacgcggagctgcccaccccctggagggtcttggggttctggaagaagcagccccctactaggcggaaatgggaaggccaccatgcagaatctcaacgaccgcctggcctcctacctggagaaggttcgcgccctggaggaggccaacatgaagctggaaagccgcatcctgaaatggcaccagcagagagatcctggcagtaagaaagattattcccagtatgaggaaaacatcaca

SEQ ID NO: 3211 - DNA, 128 bp, Homo sapiens
aatacccgcctgatgtcgtgggccacacctccgggttaccaggggaagggaggaagcaaactgtcatattgatgtggctctaaacaacaacagtgtgcgaaggcccaggggcactttgggattgacca

SEQ ID NO: 3212 - DNA, 124 bp, Homo sapiens
taagagcgagtcctttgaaagtactttccttcaaacagtgactgccacaaaggcatcagatattcaccaccttctcggctgcctcagcacagcaagctttattctgggacctgagatcctgttc

SEQ ID NO: 3213 - DNA, 163 bp, Homo sapiens
tcaaccacatttgacagcccatggcaggtttcctgttttccatcgtccctctgcaggtcacagacacacagagcccagccgtggcaggctcagccggggtccggggctgctaacaacggctacattcctcccccagggccaagggaaatcctgagcgcaggcc

SEQ ID NO: 3214 - DNA, 36 bp, Homo sapiens
tctgctgtcctttggagggtgtcttctgggtagagg

SEQ ID NO: 3215 - DNA, 26 bp, Homo sapiens
acaatttgtctgcctccaaggtcctc

SEQ ID NO: 3216 - DNA, 115 bp, Homo sapiens
gcccagctggcgcatatccaggcgctgatcagcggtattgaagcccagctgggcgatgtgcgagctgatagtgagcggcagaatcaggagtaccagcggctcatggacatcaagt

SEQ ID NO: 3217 - DNA, 29 bp, Homo sapiens
ccttggaagacacactggcagaaacggag

SEQ ID NO: 3218 - DNA, 92 bp, Homo sapiens
cgcttccctgtgcaattcacacttatacccttgcagcctagggcagcctggccggtggctgtgcccatgccctctccgggaaccaggctctg

SEQ ID NO: 3219 - DNA, 37 bp, Homo sapiens
cagatgagcaggtccgaggttactgacctgcggcgca

SEQ ID NO: 3220 - DNA, 85 bp, Homo sapiens
aggtggattccgctccgggcaccgatctcgccaagatcctgagtgacatgcgaagccaatatgaggtcatggccgagcagaaccg

SEQ ID NO: 3221 - DNA, 100 bp, Homo sapiens
cctgggtgtgggatcatggatcccagggttccaagaggaatcagtgatgacccagtctgtcccccagtgctagttactaggcctgcacctgaaaactaag

SEQ ID NO: 3222 - DNA, 32 bp, Homo sapiens
tttgagacggaacaggctctgcgcatgagcgt

SEQ ID NO: 3223 - DNA, 61 bp, Homo sapiens
ccctcacctagcctagatggcctgaagctaacccccctatggactcctgaactctggggag

SEQ ID NO: 3224 - DNA, 31 bp, Homo sapiens
gaactccaggattgtcctgcagatcgacaat

SEQ ID NO: 3225 - DNA, 47 bp, Homo sapiens
ggaagaaagtgagtgggcagtgcctgtgtgttgaactggtaccaacc

SEQ ID NO: 3226 - DNA, 241 bp, Homo sapiens
ggggcaaaatatgcttcgcatagtggggggggcaggtatagacaaaatctaccccccatctggtttatagacccccttcaggccatttagagtttcattgcacacaggtctcagagatttcctccccaggcttgccttcctgccctcccccacccaagtccccctggctccagttttcttcctgccccagcttctgggcatggactgtttgcaaggcctcccagagagcgggccaatgggc

SEQ ID NO: 3227 - DNA, 320 bp, Homo sapiens
tatcgccagtcgtcggccacgtcgtccttcggaggcctgggcggcggctccgtgcgttttgggccgggggtcgcctttcgcgcgcccagcattcacgggggctccggcggccgcggcgtatccgtgtcctccgcccgctttgtgtcctcgtcctcctcgggggcctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagat

SEQ ID NO: 3228 - DNA, 676 bp, Homo sapiens
tccgcagtggcctcctaatttccttctttggagttgggggaggggtagacatggggaaggggctttggggtgatgggcttgccttccattcctgccctttccctccccactattctcttctagatccctccataaccccactcccctttctctcacccttcttataccgcaaacctttctacttcctctttcattttctattcttgcaatttccttgcaccttttccaaatcctcttctcccctgcaataccatacaggcaatccacgtgcacaacacacacacacactcttcacatctggggttgtccaaacctcatacccactccccttcaagcccatccactctccaccccctggatgccctgcacttggtggcggtgggatgctcatggatactgggagggtgaggggagtggaacccgtgaggaggacctgggggcctctccttgaactgacatgaagggtcatctggcctctgctcccttctcacccacgctgacctcctgccgaaggagcaacgcaacaggagaggggtctgctgagcctggcgagggtctgggagggaccaggaggaaggcgtgctccctgctcgctgtcctggccctgggggagtgagggagacagacacctgggagagctgtggggaaggcactcgcaccgtgctcttgggaagga

SEQ ID NO: 3229 - DNA, 31 bp, Homo sapiens
attattttgattgctggaataaagcatgtgg

SEQ ID NO: 3230 - DNA, 193 bp, Homo sapiens
ttctaaaggtgctatttaacatgggaggagagcgtgtgcggctccagcccagcccgctgctcactttccaccctctctccacctgcctctggcttctcaggcctctgctctccgacctctctcctctgaaaccctcctccacagctgcagcccatcctcccggctccctcctagtctgtcctgcgtcctctgt

SEQ ID NO: 3231 - DNA, 545 bp, Homo sapiens
tccacttgcttgaagacccatgcgggggtaagtccctttctgcccgttgggcttatgaaaccccaatgctgccctttctgctcctttctccacaccccccttggggcctcccctccactccttcccaaatctgtctccccagaagacacaggaaacaatgtattgtctgcccagcaatcaaaggcaatgctcaaacacccaagtggcccccaccctcagcccgctcctgcccgcccagcacccccaggccctgggggacctggggttctcagactgccaaagaagccttgccatctggcgctcccatggctcttgcaacatctccccttcgtttttgagggggtcatgccgggggagccaccagcccctcactgggttcggaggagagtcaggaagggccacgacaaagcagaaacatcggatttggggaacgcgtgtcaatcccttgtgccgcagggctgggcgggagagactgttctgttccttgtgtaactgtgttgctgaaagactacctcgttcttgtcttgatgtgtcaccggggcaac

SEQ ID NO: 3232 - DNA, 114 bp, Homo sapiens
gacaatttcacatggactttggaaaatatttttttcctttgcattcatctctcaaacttagtttttatctttgaccaaccgaacatgaccaaaaaccaaaagtgcattcaacct

SEQ ID NO: 3233 - DNA, 187 bp, Homo sapiens
agctgaccttcctgcgcctgatgtccaccgaggcctcccagaacatcacctaccactgcaagaacagcgtggcctacatggaccagcagactggcaacctcaagaaggccctgctcctccagggctccaacgagatcgagatccgcgccgagggcaacagccgcttcacctacagcgtcactgtcga

SEQ ID NO: 3234 - DNA, 124 bp, Homo sapiens
agactggtgagacctgcgtgtaccccactcagcccagtgtggcccagaagaactggtacatcagcaagaaccccaaggacaagaggcatgtctggttcggcgagagcatgaccgatggattcca

SEQ ID NO: 3235 - DNA, 168 bp, Homo sapiens
agcgctggtttcgacttcagcttcctgccccagccacctcaagagaaggctcacgatggtggccgctactaccgggctgatgatgccaatgtggttcgtgaccgtgacctcgaggtggacaccaccctcaagagcctgagccagcagatcgagaacatccggagccca

SEQ ID NO: 3236 - DNA, 36 bp, Homo sapiens
ccaaagcacttggatgccggtaatccccactctctt

SEQ ID NO: 3237 - DNA, 76 bp, Homo sapiens
cctggcaaagatggactcaacggtctccctggccccattgggccccctggtcctcgcggtcgcactggtgatgctg

SEQ ID NO: 3238 - DNA, 27 bp, Homo sapiens
tggtgaacaaggtccctctggagcctc

SEQ ID NO: 3239 - DNA, 54 bp, Homo sapiens
tgagacaggcgaacagggcgacagaggcataaagggtcaccgtggcttctctgg

SEQ ID NO: 3240 - DNA, 42 bp, Homo sapiens
tgctggtcccaccggtcctgtcggccctgttggcgcccgtgg

SEQ ID NO: 3241 - DNA, 106 bp, Homo sapiens
tgaccgtggtgagaccggccccgctggaccccctggtgctcctggtgctcctggtgcccctggccccgttggccctgctggcaagagtggtgatcgtggtgagact

SEQ ID NO: 3242 - DNA, 51 bp, Homo sapiens
gctcctggtgccgaaggttcccctggacgagacggttctcctggcgccaag

SEQ ID NO: 3243 - DNA, 93 bp, Homo sapiens
ggcaaacaaggtccctctggagcaagtggtgaacgtggtccccctggtcccatgggcccccctggattggctggaccccctggtgaatctgga

SEQ ID NO: 3244 - DNA, 62 bp, Homo sapiens
gtactcccgggcctcaaggtattgctggacagcgtggtgtggtcggcctgcctggtcagaga

SEQ ID NO: 3245 - DNA, 42 bp, Homo sapiens
gctggcaaagaaggcggcaaaggtccccgtggtgagactggc

SEQ ID NO: 3246 - DNA, 53 bp, Homo sapiens
gtgctactggtttccctggtgctgctggccgagtcggtcctcctggcccctct

SEQ ID NO: 3247 - DNA, 29 bp, Homo sapiens
ctggagccaaaggtgctcgcggcagcgct

SEQ ID NO: 3248 - DNA, 72 bp, Homo sapiens
tgctgacggccaacctggtgctaaaggcgaacctggtgatgctggtgctaaaggcgatgctggtccccctgg

SEQ ID NO: 3249 - DNA, 53 bp, Homo sapiens
gagaccgtggtgagcctggtccccccggccctgctggctttgctggcccccct

SEQ ID NO: 3250 - DNA, 157 bp, Homo sapiens
gtaagtacagaagacctgttaagaccccatacttggcccttccctcccttcacacagcacccctggccctgtctgtgccttcaccccttgcctctcccctcaccgcatccccgccttccctcctgtcagcgcatctctccaatctgactccttttct

SEQ ID NO: 3251 - DNA, 67 bp, Homo sapiens
tgctggtcccaaaggtgctgatggctctcctggcaaagatggcgtccgtggtctgactggccccatt

SEQ ID NO: 3252 - DNA, 87 bp, Homo sapiens
agctcccggtagccagggcgcccctggccttcagggaatgcctggtgaacgtggtgcagctggtcttccagggcctaagggtgacag

SEQ ID NO: 3253 - DNA, 79 bp, Homo sapiens
cgagcgtggtgtgcaaggtccccctggtcctgctggtccccgaggggccaacggtgctcccggcaacgatggtgctaag

SEQ ID NO: 3254 - DNA, 31 bp, Homo sapiens
ggtgttcctggagaccttggcgcccctggcc

SEQ ID NO: 3255 - DNA, 229 bp, Homo sapiens
ctgctggaatatgctgtgactttccctcaacccttctattgataaatcttggtccatagtttggggaggggggaagcctttgacacatccctaggaggaagagaggggctgtttgggataatctcaattcagtgctgagaaggggttcctctctaatcacggccagaccccaggaggaaggaccgtgctttccagcagagtggccccaggtgggttttgctcactgtct

SEQ ID NO: 3256 - DNA, 26 bp, Homo sapiens
gtgaagcaggcaaacctggtgaacag

SEQ ID NO: 3257 - DNA, 26 bp, Homo sapiens
ctggagagcgaggtgttcccggaccc

SEQ ID NO: 3258 - DNA, 78 bp, Homo sapiens
agagccagggacaaacacacctgagacttgaaggagtcctgggctctgggctcagctgtgccgctgacctgccgtgtg

SEQ ID NO: 3259 - DNA, 29 bp, Homo sapiens
tgggattccctggacctaaaggtgctgct

SEQ ID NO: 3260 - DNA, 25 bp, Homo sapiens
tcaagatggtcgccccggaccccca

SEQ ID NO: 3261 - DNA, 29 bp, Homo sapiens
gtcctcactgctgctttcgtgcctcccat

SEQ ID NO: 3262 - DNA, 25 bp, Homo sapiens
ctggtcctgatggcaaaactggccc

SEQ ID NO: 3263 - DNA, 37 bp, Homo sapiens
tgaagctggtcgtcccggtgaagctggtctgcctggt

SEQ ID NO: 3264 - DNA, 33 bp, Homo sapiens
gtcccgctggtgaacgtggttctcctggccctg

SEQ ID NO: 3265 - DNA, 26 bp, Homo sapiens
gtttccctggcgcagatggtgttgct

SEQ ID NO: 3266 - DNA, 46 bp, Homo sapiens
ggagctcgaggtgaacccggacccactggcctgcccggaccccctg

SEQ ID NO: 3267 - DNA, 36 bp, Homo sapiens
ggcagcaaaggagacactggtgctaagggagagcct

SEQ ID NO: 3268 - DNA, 61 bp, Homo sapiens
tgctcctggtattgctggtgctcctggcttccctggtgcccgaggcccctctggaccccag

SEQ ID NO: 3269 - DNA, 49 bp, Homo sapiens
ggccccgaggctctgaaggtccccagggtgtgcgtggtgagcctggccc

SEQ ID NO: 3270 - DNA, 51 bp, Homo sapiens
cccaccggccccgctggtcctcctggcttccctggtgctgttggtgctaag

SEQ ID NO: 3271 - DNA, 44 bp, Homo sapiens
gtgctcgtggaaatgatggtgctactggtgctgccgggccccct

SEQ ID NO: 3272 - DNA, 43 bp, Homo sapiens
ggcccccgtggcctgcctggtgagagaggtcgccctggagccc

SEQ ID NO: 3273 - DNA, 35 bp, Homo sapiens
gcagccctggtgaaaatggagctcctggtcagatg

SEQ ID NO: 3274 - DNA, 25 bp, Homo sapiens
tcactcattattctctgatctacag

SEQ ID NO: 3275 - DNA, 34 bp, Homo sapiens
tggtttggatggtgccaagggagatgctggtcct

SEQ ID NO: 3276 - DNA, 40 bp, Homo sapiens
agctggaaaacctggtcgtcctggtgagcgtgggcctcct

SEQ ID NO: 3277 - DNA, 30 bp, Homo sapiens
ccaggtccccctggaaagaatggagatgat

SEQ ID NO: 3278 - DNA, 27 bp, Homo sapiens
caaggcttccaaggtccccctggtgag

SEQ ID NO: 3279 - DNA, 55 bp, Homo sapiens
cccagctgtcttatggctatgatgagaaatcaaccggaggaatttccgtgcctgg

SEQ ID NO: 3280 - DNA, 25 bp, Homo sapiens
tggacagcctggacttcccggaccc

SEQ ID NO: 3281 - DNA, 27 bp, Homo sapiens
aggcccccctggccgagatggcatccc

SEQ ID NO: 3282 - DNA, 32 bp, Homo sapiens
ccaagggagacactggcccccgaggcccaagg

SEQ ID NO: 3283 - DNA, 25 bp, Homo sapiens
cgaccaagaaaccaccggcgtcgag

SEQ ID NO: 3284 - DNA, 119 bp, Homo sapiens
cctgcgtacagaacggcctcaggtaccatgaccgagacgtgtggaaacccgagccctgccggatctgcgtctgcgacaacggcaaggtgttgtgcgatgacgtgatctgtgacgagacc

SEQ ID NO: 3285 - DNA, 99 bp, Homo sapiens
tcagctttgtggacctccggctcctgctcctcttagcggccaccgccctcctgacgcacggccaagaggaaggccaagtcgagggccaagacgaagaca

SEQ ID NO: 3286 - DNA, 1064 bp, Homo sapiens
tggtctgtaacacctgcacatctttttatacgtgtagagggtatgcctgggatatataggttgtcttcaagcagtagctgctactacagctagagagaggaggagtgccaggaaactgatgacctgagaccaagagtcttgttgatgttctgacttagataaaggttttgatcattttcatgaaataatgcagggaagtcatttctgctgtttctttactactccattcttggaggattagaacaagtcacactgtaattgactaaaacgactttttattttaaaatattgatggtggggttttgcttttttttttttttttttttttgagacgttgtcttgctctttcacccagggtagagtgcagtggcgaaatcttggctcactgcaacctctgcctcccgggttcaagcaattctctgcctcagcctcctgagaagctgggattacagcgcctgccaccatgcctgtctagtttttttgtatttttagtagagacaggggtttcaccaagttggccaggctggtcttgaactcctgacctcgtgatccacccacctcggcctcccaaagtgctgggattacaggcgtgagccaccgtgccgggccagtgtttttaactgtccacacttactaaattttccagtacttcttcctatggttcatgatagtaaacacagaaacatataaggaacattattagagttaccagatgttagctgttgcatatgtgcacattcctagattcaagggtgtttttgccttaaatttaagtgggtcattggttgtcttgggaagatcatggaaaattcgggattttttagaattctgaaccaaaatatgttttgagtgtttcttagtaaatgtgtgatcttccaccttccacattcagactgcggactacacttcataaatgcctttttatttccagttatggattcaactaaatgactgccttgggagcacataattactttgctacctttttccccctttgctgttgtggctcgagtttggttctcacctgagaagatgcattgagcatatgttgttacccagccctg

SEQ ID NO: 3287 - DNA, 1219 bp, Homo sapiens
gctccagtcactttaggagtccttggaagtacttggtacacatttgttggctgtaccttaaaggaagtggcaagtccagtttgttctctctaccacactagactgccactgacaagtttgggtctgttggattcaaaattttgtaagccattttcacaagtacaaagatacattttaaccttgtcttctccaaaattactgagtaggaattttatttttatctttttgagacagggtatcactgtcacccagactggagtgcagtggtgggatcttggcttactgtgacctctgcctcccgggttcaaatggtcctccctcctcagtctcctgagtagctgggacgacaggcacgtgccaccatgcccagctaatttgttctattttttctgtagagacggggttttgccatgttgcccaggctggtctcagactcctgggctcaagcgatcatttcgcctcagcctcccaaagtgctgagattataggtgtgagccacagcatctggcccagagtgaggagaattaatgagattttttgtgtgtgttagataatattgatttaagcctttttttaaaaagtactctcaaccaaatacaaaattgaaaatgtgaggtttaatagaaatgtgttggctatttgcaatggattttcttcttgcccaagtgtttggagttctactttatgctctgtatttaaaaattagtgacctcaaagcagagttgatgacacaggctttggggccctcatgttcttgtctttagaacatatcactactaagtatcagcttatcttcagaacattacaacattcaccgtgttcatatgctttctgagaagtcaccacttgtaatttcagatcacatacacctgaaggcattttatagttcctaaagttaacatgttagatcttttttttccaccccatgagggtctcactctcacccaggctggaatgcagtggtgtgattgtagcacactttggccaccaactcctgggctcaagtgatcctcctgctttggcctcctctgagaagctgggattactggtgcacaccaccacacctggctaattttttatttttttttatttttggaaatagggtatggctatgttgccttgggcccgtcatgaactcctagcctcaggtgaccctcccacctcaggcctcccaaagggttgggattacaggagtgagctactgcactgggccaacatg

SEQ ID NO: 3288 - DNA, 371 bp, Homo sapiens
aactcctatcttgggacctgacataatatctatctatcctggggaactggtaatatgagacttataggttacagcagaaatgctacatgttgacaaaagccttaatcgttccactgggagaactaattgataattgtgttaagattgaagattaaccctgtgttaatctcacttgagtctatcctgacagtagttcagattctggaaaatgataaactgacctgctagatgtagaattgtttcaaaattagtgttgaaataccttgttcacagatgaatatctgggcaggatctgagggtgtttggaatgacaccccccaatccagttgcatagatgggatgtctttgcaggtttgaggagatcatcgacc

SEQ ID NO: 3289 - DNA, 244 bp, Homo sapiens
tgtcacttaggtcagcactcccagacgtagcacagaaaaaccctttgacacaaaccatgtgttctgatttttggttcagaaaatattgaaactgtgagttgttttttttttaacaactgggaaaaaacaaaaacaaaaaactatagttagaaaaatggaagttccataggttctatttcttactctatgtatggctttgttttcagtctatttctaggagctttctctgaatcgctaattgtcc

SEQ ID NO: 3290 - DNA, 146 bp, Homo sapiens
gctagcatttttccaacgagggaacttattccgcacgggcctactgtaggaccattgtctcgtgtaattaggaattttccatttgaaggattgctaaattgtcacagtagtaggaagtatagggaaacctctcagctgtggcactg

SEQ ID NO: 3291 - DNA, 26 bp, Homo sapiens
tggggcctggcttaaaagcaggattg

SEQ ID NO: 3292 - DNA, 370 bp, Homo sapiens
gcgcctgtgtgcaactcaaattttgtggaatctttttcgaattcaaatagctatagagcaaatgataaattgacccctttttataaatggagggaaaaaatgaacagatttcagagattaaatgaaaaaaagcagatgttttaagtgcaattaacactgaaagagacctgttaaaccattcagaaaaagcttaagaaatgcgatatgacttccttttgtaatgctgctgatcccagtagactatgacttttgataattagcagaatttaactactgagtagttgattattttcacattttaattgctaatcactggctatataagtgtttttaagcaaaggtatttttgaagtggtgtagaacccttcca

SEQ ID NO: 3293 - DNA, 120 bp, Homo sapiens
cagcgtgtaaaggagttactcactctgattcgctcagatgctgttgctttggttgatgcatttgattttcaggatgtgacacttggctctgtgcttggccgctatgatgggaatgtgtat

SEQ ID NO: 3294 - DNA, 29 bp, Homo sapiens
aaagcaaggaggtagcttggaacctaact

SEQ ID NO: 3295 - DNA, 47 bp, Homo sapiens
ttagtagaaattgctgcaaaaaaccttcaaaaagaagtgattcacag

SEQ ID NO: 3296 - DNA, 102 bp, Homo sapiens
atttgaacgacctgcccagtcagcgcatccagccacagcaggtagcagtctggccaaccatggtggatatcaacagccccgaaagcctaaccgaagcatata

SEQ ID NO: 3297 - DNA, 184 bp, Homo sapiens
gccctcaccgctggactgaaggctttcacctcctggactgcaaacactggcattgaagcatgtcggatggcttgtggtgggcatggctattctcattgcagtggtcttccaaatatttatgtcaatttcaccccaagctgtacctttgagggagaaaacactgtcatgatgctccagacggcta

SEQ ID NO: 3298 - DNA, 90 bp, Homo sapiens
gcagtataaactctttccactcctggccactgcctatgccttccagtttgtgggcgcatacatgaaggagacctatcaccggattaacga

SEQ ID NO: 3299 - DNA, 142 bp, Homo sapiens
ttcagatcccagaattcccaaatgtcaatacagaagatgcattagcactgcaaaattggctagggtgataactgggcctgtaatttcatatctaggcttccttttcttaagaggaaagacagaaataaccacccttgctata

SEQ ID NO: 3300 - DNA, 158 bp, Homo sapiens
tgatggcacatacgtgaaaccgctgagtaacaagctgacttacgggaccatggtgtttgtcaggtccttccttgtgggagaagctgctcgggctctgtctaaggcgtgcaccattgccatccgatacagcgctgtgaggcaccagtctgaaatcaagc

SEQ ID NO: 3301 - DNA, 91 bp, Homo sapiens
catgcaatagttcttgcccagctcatcactaaggggaaatgctatggattacatgcctttatcgtacctattcgtgaaatcgggacccata

SEQ ID NO: 3302 - DNA, 38 bp, Homo sapiens
gtaagtgaatttttcagcatttattggatgttttgaag

SEQ ID NO: 3303 - DNA, 130 bp, Homo sapiens
cctctggatcttcacttgggcatgttcctgcccaccttgcttcaccaggcaactgcggagcagcaggagcgcttcttcatgcccgcctggaacttggagatcattggcacttatgcccagacagagatgg

SEQ ID NO: 3304 - DNA, 171 bp, Homo sapiens
ccacctcaggacatcagttaacagtgattgctggcatttgacttttttctgctgctacctgtttgggattctatttttaagttgttaagtcaaaattcaacttcttgttttctcctagacattttccctggaaactggtccagggctctggcctataaacgtcattcactg

SEQ ID NO: 3305 - DNA, 137 bp, Homo sapiens
acctgtgggcctcaattactccatgtttattcctaccttgctgaatcagggcaccactgctcagaaagagaaatggctgctttcatccaaaggactccagataattggcacctacgcccagacggaaatgggccacg

SEQ ID NO: 3306 - DNA, 26 bp, Homo sapiens
agagcaagtgttgttaagcctaaact

SEQ ID NO: 3307 - DNA, 28 bp, Homo sapiens
atgagggagtttggcatcgctgaccctg

SEQ ID NO: 3308 - DNA, 78 bp, Homo sapiens
gaacatgatcctgaacgacccagacttccagcatgaggacttgaacttcctcactcgcagccagcgttatgaggtggc

SEQ ID NO: 3309 - DNA, 77 bp, Homo sapiens
atgaacccggacctgcgcagggagcgggattccgccagcttcaacccggagctgcttacacacatcctggacggcag

SEQ ID NO: 3310 - DNA, 189 bp, Homo sapiens
gccgctgtcactcacgcgccaaagggccacggagaaagaaggggcgggccggggcgggccgggcgagcggaggcggggacttgcgccgtcctgaggctgcctcctagggtccggccggcgctggagctgcggatttagattgtcactgccacctcggtcggtgcttacttcgctgccagctggtcgtcg

SEQ ID NO: 3311 - DNA, 26 bp, Homo sapiens
tcggtccgtggacaataaacagtatt

SEQ ID NO: 3312 - DNA, 164 bp, Homo sapiens
cttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgc

SEQ ID NO: 3313 - DNA, 795 bp, Homo sapiens
acggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgata

SEQ ID NO: 3314 - DNA, 52 bp, Homo sapiens
gcctccaagggtttcgactggtccagctctgacatcccttcctggaaacagc

SEQ ID NO: 3315 - DNA, 139 bp, Homo sapiens
tgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcg

SEQ ID NO: 3316 - DNA, 587 bp, Homo sapiens
ggcactgcaggccttacgctgtttccaacattcccgacattttcacacctgggttggtgtctatgtggggtctgtgtgttgagaatacctgaacacctgctcctcttaaaatgagcccggaggttgtgccaggcacagctggagcagtgcagcgcctagatgtggctgtggaaggtgagattaccgcctccagggctcccaggctggctcctaccctgtgggctcctagcaccctatccccaccctccctgcaggaagcatggctgagtgctgggcacctcccaccctgggtcactcccagtgagtctgggaccaggagactctggtgaggctgtggggattggccttccctggggagctgcctggggctgccctccctcctgacggcccccagccccttctccgcatgttcaaaacaggaattctgaactcatagtctccagccacacgtatgttaagcgaaactcctctgtgcccagcatgaaatcaaaagcaagtttttcctttttctttccacggtggtgaaggcggtcatcctcttgtagcctagggttccttggccaaattgctagttgccgatgacctcg

SEQ ID NO: 3317 - DNA, 25 bp, Homo sapiens
gtaccagatgggctgcgagtgcaag

SEQ ID NO: 3318 - DNA, 46 bp, Homo sapiens
gcaagatgcacatcaccctctgtgacttcatcgtgccctgggacac

SEQ ID NO: 3319 - DNA, 67 bp, Homo sapiens
ggatatagagtttatctacacggccccctcctcggcagtgtgtggggtctcgctggacgttggagga

SEQ ID NO: 3320 - DNA, 98 bp, Homo sapiens
tgatcagggccaaagcggtcagtgagaaggaagtggactctggaaacgacatttatggcaaccctatcaagaggatccagtatgagatcaagcagata

SEQ ID NO: 3321 - DNA, 69 bp, Homo sapiens
gcaggcctggacgtcttatccctctccttagccccaggagcgtgtttcaggaactctcctcacctctgt

SEQ ID NO: 3322 - DNA, 63 bp, Homo sapiens
gaggagacgccatgccgggggctgggatcaccatgccccttgcccgtctcgcaccttgctgct

SEQ ID NO: 3323 - DNA, 27 bp, Homo sapiens
cccacccggggtaaatacatcactgat

SEQ ID NO: 3324 - DNA, 52 bp, Homo sapiens
gtttcttgaagaagcccggaaatgcttgcgggagtttcagaacatatgctaa

SEQ ID NO: 3325 - DNA, 1185 bp, Homo sapiens
ggctgagcctctgtcctgataacgaagacctgctttggaggaaaaagcacaaattgctacaagcccggggcaaaggcgatctcgctctgcagagaagagcggatgccaagctgtggaaaaactaccagctccagcgcttggctgaggagttgaggagagggtatcaggaggcacagcacctgcacgtcggtggcctggacaggctgcagtcagcacgtctgttgggctggggaggaggacgggccagggaaaatgagcctgactcgcaggggcccatccagcgaagatcagccaggcccccgagggccaaggagaagcatagagcagcccttagtgaagagaggagttgcagggaagagttgggccagcaacaccccaggcactccaggccccggaagacagcagcgagtccagagaaaccacagactacaaaagccacgggtcggatgaattctcacctggccccgcctgagaagagaaagggaaggccagaaccttcgaccaagtctgggggtggccgctgtgccatccatcctcggaggagcaaaggggcggacctagaaaggtcaaacccactcgtggctgctgtgggagaaatcgggcttgtggaggaaaaagagaaaggaacagctcgggcggggaggaggcaactgggaaagggggcagtttgctttgttccagccctgaccagtcgctctcagggacagagtctggaggggaagctgagagacctcgggcagctgtggccagctgattccagctgcagaagggaagccgtgtccccagcatctcagtgcacgctccgggagaagaacaagtggcagaaagagctggagttggcctttgaagagttgtttaatataaacagaaagctgaaaaaacacctgtgcttgtacctggcactgaagcccaggatggaccagagacctggggaagggcatgccttctcagagatgcaagagtgtggcgctgggaccccaagagggaagaaaatggcagacccagagatgctgcctgccggggaacccaggagcccagcagaggaggaggcgcagcaggcagcgtccaagaccgacttgaaaacgttcatgggcaaggcccagaaccaaaaatatcagggcacggtcaagcccacgtttagaaatggaagtcaaacattgtctcccgaggcaggtatatttatca

SEQ ID NO: 3326 - DNA, 126 bp, Homo sapiens
tttgctgtggaacgttgtggcttctgtggctcctcaggcccgggggcgccccttgaaccctccactcttggctccaagcaccttccctgggaagctgtatctgctgggttcgcagacaggaacaga

SEQ ID NO: 3327 - DNA, 170 bp, Homo sapiens
aggcacttcgtagctgttgaccatcatttagctccacgtctgcccgtcggttcctcgtgcgtggaatccagcaccacgtgggtgtctctgccgagctctcggcatttcctgagccctcccggaagccagactctgttctcggcgcttcacacgggccgtctcgtctgatg

SEQ ID NO: 3328 - DNA, 100 bp, Homo sapiens
ccagtgatttcaagacagccctggagacagtgcttcctgccctcctgtcagcttctgcctccctgtaatgtgttctgggtggtctagctcagtcatctgg

SEQ ID NO: 3329 - DNA, 30 bp, Homo sapiens
caggtggaggcggggaagcgattccggcca

SEQ ID NO: 3330 - DNA, 209 bp, Homo sapiens
cggcgagctcagcaaccggaaccgagggaagattttggctccgcgggctcgccctccgctccctctgccagcggcgccagacgccgagtggggccagggacaggggaggaggacccaggaccctgtgcccgcgcccctggagccgctggagttcggacttctgcaactgttggcactttgggggcttggcttagcgctctgctgtttac

SEQ ID NO: 3331 - DNA, 56 bp, Homo sapiens
gacttgggacttgcctggcgactttggccggacttttgctaactgcggcgggcgag

SEQ ID NO: 3332 - DNA, 169 bp, Homo sapiens
gccggagcatgcttctctaatcttaccatttatcactgacccttcggtgaaactctcttctgtttaaatttaccagggtacactttgtaatacttgggaccaagaatttgaagatagtaatcagacaaatcaaacaactagtagtagtggagagacacgtagccctaca

SEQ ID NO: 3333 - DNA, 104 bp, Homo sapiens
ggctgcctctttgatgagccgtatagcacatgtggatatagtcaatctgaaggtgatgacttcaattgggagcaagtgaacaccttgactaaaccgacttctga

SEQ ID NO: 3334 - DNA, 275 bp, Homo sapiens
cctgcaacaaacttgctggggcctgctgtgtgtacacactgtatcaggctgggtgtacctcgttaagcacataggtggtaaaataagtaccacggtaaaattatggcttagggctcagggtaaaattataaaaaaggaacagattacatcccactgtgggcaataagaaacactttctgcaggattctgagatgggcctggaagaatggatgatatttcaacagggggtaatgaggaaatgcagtttcggtgtgggcacctgaacggacaaaagg

SEQ ID NO: 3335 - DNA, 1144 bp, Homo sapiens
ctgggaaacctgcatcacctaattcactggagagggataatagtgatgctataaatagcaaatgaagtcagttgggctcttatatgtgttgagcaccaccatccatctgaatagttgcttaagccagaaactggggagtggccccagctgcttcttccttcccttcatccagaaagttagcagttcctggattttcctcctctagaatgtccctcaaacctgtcctcttttgtcttttctcatgtctgccacacttgtcttagtcattagcgaaatatccacattttatacttctgttttgaaactgacggaattgtcccagaaaactgatgtttatggtttcttttaaataagtacagaaatttaccctcccagtcttaaatcttgagaaagttacatttatcttatctgagttcctttttcaggaaaccaatcatcagtcctcccagtcttaaatcttgagaaagttacatttatcttatctgagttcctttttcaggaaaccaaccatcagtcctcccagatagtatcaaggaactgaaactttccagatcacagcatcaggacagtgagacaccacacccctcacccaacatgattgcctagcccaccacctactgcctgttggctaactcctcttccttaccctttcctggtcttgttttcccacatgtcattacgtttctttcctgctgtgtaaatccttaattttagttggcttaggagatggatttgagactgatctcccattctcctctgccgcagtacccgaataaagcctggcaatactctttgtcctagtaattggcctcctgtgcggcagcagtgacacctatctgtaccatacctttgacgctttgggggcagttctgtgaaggtgggaaaattgattgtggaataaagtgatacatttggtttggggcatgtttctatcttattaatagtatatttttcctcatagagatgtctactacacagttagaaataaaggcctaagctgggcatcattgcccttgcctgcaatcccagctactaggtaggttgaggtggaaagatcgctcgaggccaggattttgagactgtagtgtgcaatgagcatgcctgtgaatagccactgcgctctagccgggcaataataatatta

SEQ ID NO: 3336 - DNA, 34 bp, Homo sapiens
atgctggtgaatgcctctgggagacctgaggggc

SEQ ID NO: 3337 - DNA, 94 bp, Homo sapiens
cctccggggttactcaatgtctacgtgaaggtcaataacgggccactggggaatcctatctggaatatatctggagacccaacacgtacatgga

SEQ ID NO: 3338 - DNA, 55 bp, Homo sapiens
agtgataacttctggacatcaaggctatctcgctatcgatgaggtgaaggtgtta

SEQ ID NO: 3339 - DNA, 68 bp, Homo sapiens
cacttcctgcggattcagaatgtggaagttaatgctggccagtttgctaccttccagtgcagtgccat

SEQ ID NO: 3340 - DNA, 53 bp, Homo sapiens
aggaagggctgagcatgcctagcccagccccttctttggggagctgactgcct

SEQ ID NO: 3341 - DNA, 127 bp, Homo sapiens
tgtgcgagatgctcctctgaaggaaatcaaggtgaccagctcccgacgcttcattgcttcatttaatgttgtgaataccaccaaacgagatgctggaaagtaccgctgcatgattcgcactgaagga

SEQ ID NO: 3342 - DNA, 165 bp, Homo sapiens
agctcgcctctgtaggagccacctacctgtggatacagctcaacgccaactccatcaatggggatgggcccattgtggcccgagaggtggagtactgcacggccagtgggagctggaatgaccggcagccagtcgattccacgagctataaaattggacaccttg

SEQ ID NO: 3343 - DNA, 26 bp, Homo sapiens
taagacggagagcatgcagtctgagt

SEQ ID NO: 3344 - DNA, 55 bp, Homo sapiens
aagcacaacagagatgtgagtcacaacacagaaacttggaaaggcttttcacaga

SEQ ID NO: 3345 - DNA, 253 bp, Homo sapiens
tgcgaggcccaagaaaactagaagtagtggaggtcaaatctcggcaaatcactatccgctgggagccatttggatataatgtaactcgttgccacagttataatctcactgtccactactgttaccaagttggaggacaagaacaagtgcgagaagaagtaagctgggatacagaaaactcacaccctcaacacacgatcactaacctgtcaccatacaccaatgtcagtgtgaaactgatcctcatgaaccc

SEQ ID NO: 3346 - DNA, 40 bp, Homo sapiens
gtggagagaaccaactcaaacatatggtgtaatcacttta

SEQ ID NO: 3347 - DNA, 144 bp, Homo sapiens
aagcagtcagttcctttgacccagaaatagatttatccaatcagagtggaagagtttcaaagctgggaaatgaaacccattttctgttttttggactgtatccggggaccacatactcctttaccatccgagctagcacagcta

SEQ ID NO: 3348 - DNA, 80 bp, Homo sapiens
ccctctatgccagcttatgaacttgagacacctttgaatcaaactgacaataccgtgacagtcatgctgaaacctgccca

SEQ ID NO: 3349 - DNA, 222 bp, Homo sapiens
cgacagaaatcttaaagtgctacccagtgccaattcacttccagaatgcttctctgctgaactcacagtactactttgctgcagaatttcctgcagacagcctccaagctgcgcagccttttacaattggtgataataagacatataatggatactggaacactccccttctcccctataaaagctacagaatttatttccaagctgctagtagagccaatg

SEQ ID NO: 3350 - DNA, 29 bp, Homo sapiens
gaaaccaaaatagactgtgtccaagtggc

SEQ ID NO: 3351 - DNA, 341 bp, Homo sapiens
tttcaattggaaacactgctcagtcttcacctttatttaggatgaatgtttttggttttgttttcctttttttcttcttcagttgatctatccaagatctcagccaaaccttgcaactgtgtcatagttagaaatccaactgcctgactagagcttgtttaagggaaaagaattcagaatattcagcaccttgctatgttttttttttctttttttccttttctttttgttgttgttagaacaaagttgagacaatttgatatactgatggggattcttcttgctagcctagcttcagtctggcttttttttccctcatgcatgctgacctggaaatcctc

SEQ ID NO: 3352 - DNA, 74 bp, Homo sapiens
ctgcgataatcgtgactcagcttacaacaccttacattcgcatcgcccccgctgcaggcgacggccaactaaca

SEQ ID NO: 3353 - DNA, 103 bp, Homo sapiens
ccagaacccgagaaacagacagaccatacagttaaaattgctggagtcatcgcgggcatcttgctgttcgtgattatatttcttggagttgtgttggtaatga

SEQ ID NO: 3354 - DNA, 392 bp, Homo sapiens
gggaggcattgtcaattattagctaagattgttttgtcttctgaagaattggccctctataaaaaaatagttgtggaaggtgggcttttaacagaaaatgtaaagtctgttcagttcatactaattagtacatggaattatttaacatataggcaataatggctaaaaactgacatgaccatcagctttattttaggatgttttacaaacctatcacaaagcaacaactaattttttgttcatgtatattaattcatttggcctttacctggactaatatcatctgaaaccttcttttctttgaaacattttatgaaatgtatacacttatttttactttattatgtaagcaaagcaattttttattttccgtcccacaaattatgtgttcc

SEQ ID NO: 3355 - DNA, 28 bp, Homo sapiens
gaaactggccaagaagcggaaagagacc

SEQ ID NO: 3356 - DNA, 118 bp, Homo sapiens
tgagcagcacccgacaggagatgactgtgatggtgaactcaatggacaagagctatgctgagcagggcacaaactgcgacgaggctttctcattcatggacacgcacaatctgaatgg

SEQ ID NO: 3357 - DNA, 165 bp, Homo sapiens
ccacgttgtagtgatccaggtgccatttcagcaacagcaacatagctacacacttgtgtaccacctttcataccatgcatccccaggtgctttgcgatgcagatagaagtgaggttcccaaaccaggccctgctcatcaagcacccttggactaaattttcttca

SEQ ID NO: 3358 - DNA, 88 bp, Homo sapiens
gaaacccacacaatggccagcgataccagcagcctggtgcagtcccatacttacaagaagcgagagccggccgacgtgccctatcaga

SEQ ID NO: 3359 - DNA, 35 bp, Homo sapiens
ctgcaccatgggactcggctaagaaagatgagaac

SEQ ID NO: 3360 - DNA, 75 bp, Homo sapiens
acgatcattcccgagtgaggctgcagacaatagaaggagacacaaactcagactatatcaatggcaattatatcg

SEQ ID NO: 3361 - DNA, 46 bp, Homo sapiens
ggatggtgtggcacgaaaacactgcaagtatcatcatggtgaccaa

SEQ ID NO: 3362 - DNA, 39 bp, Homo sapiens
taccctaatagaaacagaactactggcagaatatgtgat

SEQ ID NO: 3363 - DNA, 101 bp, Homo sapiens
ccgagagatcagacagtttcacttcactggctggccggatcatggggtcccctaccatgccaccggcctgctgggattcgtgcggcaagtcaagtccaaga

SEQ ID NO: 3364 - DNA, 85 bp, Homo sapiens
actggctgtttcatcgtcattgatatcatgttggacatggccgaaagggaaggggtcgtagacatctacaactgcgtcagggagc

SEQ ID NO: 3365 - DNA, 1189 bp, Homo sapiens
agggttatctctgtgcactttgttcttctcccagggtcctgggaagaacagaagcctcctgaccctaaaaattctgcccagtgtctggcgtcctggggatttgcccattttgtgaagtactgtatactaactagtaactctgtaagtggaaattcaaggtatatcgggaatttccattttttcagaagcaatgttacatcctgctcttaggacattcgtatttttactcatatttgattgttttaagtaggcgtcacaccgaccacctggaaaatgattcatgaagtgaagtgaagaagaagtaagaatcccttacatttagatggtgcatttaagtttatgaaagcctctgggaaacctaatcccatttttttagctaacataaaaataacagaaactttaaatgctgctttcatgggttcttttccttagaaaggggatactgtgtttgaaagataataatcgtaataatttatcttttaatgtactttatagtcaatcaaatgttgccactcgcatttctcacttggatcttccattttcaggtgttgtttactggtagtgtgctgtttttgggaatcaatctgttggacaagaggttgttgaaaaaaaataattaaaggtcatatttatgtatagaaaaaaccgaattaactgtaataagaggctttttaaacttcccatataactaaagattaataataaatatgataagactctaccaatgaattttaagaaaagtcagtgccaaatcagaattagaggccccatatttacactgtgaactcattgaagatatatatgagaacagctctctgtacttctaagaggtttcataatcatattaacttttatgttctgaaataagaacttctaagtacttttatgttttgaattaagaacttccagacttcttgtcttcacagtaatgccaagtttttctggaccttctttgcactattattttgaccagcaaatcctaccatagacaaaattctgctcattcctcatgtgaaatactgagttccaagtgagtaggatcagaatgacagaggtcttcagccacagttttcatggtgctgcagtgcgtgtggtggtttgtattgggtccgattggttttaatcaatctgtgtaatatttggcattgcaccccagtctcctagcacttgagcccttggaccgtgtttc

SEQ ID NO: 3366 - DNA, 97 bp, Homo sapiens
tccacgatgcgatcctggaagcctgtctttgtggggacacctctgtgcctgcttcccaagttaggtctctgtattatgacatgaacaaactggatcc

SEQ ID NO: 3367 - DNA, 82 bp, Homo sapiens
catggtgacaccaacgctgcgagtagaggactgcagcatcgcactgttgccccggaaccatgagaaaaaccggtgcatggac

SEQ ID NO: 3368 - DNA, 102 bp, Homo sapiens
ttttatagtcacccagcatcctttgccaaacacagtgaaagacttttggagactggtcctggattatcactgcacatccgtagttatgctaaatgatgtgga

SEQ ID NO: 3369 - DNA, 104 bp, Homo sapiens
tggatatcggatggtgcagcaattccagttcctgggctggccgatgtacagggacacaccagtgtctaagcgctccttcttgaagctcattcgccaggtggaca

SEQ ID NO: 3370 - DNA, 55 bp, Homo sapiens
tcgtatgtgagatgctccggcaccagagaaccgtggatgtctttcacgctgtgaa

SEQ ID NO: 3371 - DNA, 95 bp, Homo sapiens
ctgctgatgttcaaccaccctacaaggagccccccaagctttctcccagcctagaggctggacaccagcggggctctcagggttcatgatgtgtg

SEQ ID NO: 3372 - DNA, 46 bp, Homo sapiens
atcagtacaagttctgctacgaggtggccctggaatacttgaattc

SEQ ID NO: 3373 - DNA, 591 bp, Homo sapiens
taccacaaagccaagacgttccatggtatttgtgcaaaagagatgaagacttctcaatatgcttattttgctttgcataattggctctttttaagagcccaagaaagtgtttctaaaattgcttgcactgcccaatcccagtaatgctgctgcctgacagaaacacacacacagccacagttgccaaatcccgtactccttgccaccggcttcctagagcagcgtagacagctggtaaactgaagagcacaactatattcttatgaaggaatttgtacctttggggtattattttgtggcccgtgaccctcgttattgttacagctgagtgtatgtttttgttctgtggagaatgctatctggcattatggtaatatattattttaggtaatatttgtactttaacatgttgcataatatatgcttatgtagctttccaggactaacagataaatgtgtaatgaacaaagatatgttgtatgagtcgtcgtttctgtcagatttgtattgtttccaagggaaaagcttgggggaggactcagttcacaaaatgcaaaactcaacgatcagattcacggacccagagctttt

SEQ ID NO: 3374 - DNA, 33 bp, Homo sapiens
tttgatttcatcaaattatttattcattaaaag

SEQ ID NO: 3375 - DNA, 134 bp, Homo sapiens
ggatggttaataggacctcaggctcctggtcagtgtggggcactcagacccatgagtctagaaagcaaagaacaactggattcatgtttcctatgtcagagtccacccagttgcagttccacctgagtccttca

SEQ ID NO: 3376 - DNA, 244 bp, Homo sapiens
tggctgcaccgtttgacattccctccagccgtgtatgagggttcgctttctccacgccctcgctaacacctgcgattttcttgttatgtgagccttctcgtgaatgttattccactgacattaatctcatggcaccgtcagtgattgaaatgatcttcttgttctctgtcttcgcctctggatcatgaccttcccgaggactgaatgtgtcataaaatccccagtctctagcagtacatgtgta

SEQ ID NO: 3377 - DNA, 240 bp, Homo sapiens
cttccagttgctaaggctctgtccagggccgggctcctgccaggtggcaggcagaggcttcctcaagccctgcgtccctcttctgggttcagagaccactcccaggcttggttctatcagcacactccatgcatacaggtgcagaatgctctccccggccacccgagaccacacctcagccaggaccttgtgcagagcttgcttgggccaaggtacacgatccaggaaagctgagctcaa

SEQ ID NO: 3378 - DNA, 123 bp, Homo sapiens
gttggaacgactaaagcacgctggcgcaaggaaagctctcaacttcgggagctgaggcgcaggctggccagagcgtggagaggaaagccctttccatcctcaaggccgttgcaggagatgccc

SEQ ID NO: 3379 - DNA, 112 bp, Homo sapiens
gtgctgcgatccttccttcaggtttcagtgggaatggacagacagatctgaagttgaaaattcttttcacaactcatgttcaactatgtgtgttgtcagaatgctcttaatg

SEQ ID NO: 3380 - DNA, 25 bp, Homo sapiens
accgcgccctgccaacagtagtagc

SEQ ID NO: 3381 - DNA, 35 bp, Homo sapiens
gtcttaaactttgagctcaggcagtccaccctcct

SEQ ID NO: 3382 - DNA, 256 bp, Homo sapiens
attgtctttatcagtctagtatggaaacaaaaataattgtgtaccaggagaacatggaaatgtagtatagtataacttacaaatgttgtaggggtgaatgatcaaaagccacctggcattttgctgctggtattcctgcccttactcctctcttagccccagttttgtcactttctggctttggaattggtaatgactcccacaccaggtctgaactcaacatgacatttagtgtctgagcccaccttatctttta

SEQ ID NO: 3383 - DNA, 370 bp, Homo sapiens
gtgccataggtagtgttaaattttggagctcaccattagcaaggtgaacacatgcatatgtaattgaaatacagtatggtaagtgctgtgaagaggtatgttcaggatgttctaggacacagaaaaggagtatttgtggcttatactggatggggtgggtcaccagggaggattcttggagaagtgttgctagtgcttgatttttttaaacagctttattgaggtagaactcatataagatccactcactcgaagtgtataatttaatgatttttagccagtttatgggtttctgcaaccatcaccataatccaaatttagaatgtttccatcatctacaaaatcatgcccaattgtaggcctagtgtta

SEQ ID NO: 3384 - DNA, 42 bp, Homo sapiens
gtaacagagaagacctcgtcccttcctagtcagggcatcagc

SEQ ID NO: 3385 - DNA, 89 bp, Homo sapiens
agcatggcagcgggcttacccggacccccagctctgaagagatcagccctactaagtttcctggattgtaccgcactggcgagccctca

SEQ ID NO: 3386 - DNA, 38 bp, Homo sapiens
gtagtgtctgatgatgagaaagatcatgggaagaaaaa

SEQ ID NO: 3387 - DNA, 25 bp, Homo sapiens
ctgaaggctatgcagcctttcagga

SEQ ID NO: 3388 - DNA, 46 bp, Homo sapiens
gtccttctaaaatgaagaggtccaagggaatccatgttttcaagaa

SEQ ID NO: 3389 - DNA, 36 bp, Homo sapiens
aagacttgacagcagctgatgttgttaaacagtgga

SEQ ID NO: 3390 - DNA, 68 bp, Homo sapiens
gccagaggtgcctcagattgatgttccaaatctcaaacccatttttggaattcctttggctgatgcag

SEQ ID NO: 3391 - DNA, 25 bp, Homo sapiens
cgtgaatgtatagattacgtagaga

SEQ ID NO: 3392 - DNA, 155 bp, Homo sapiens
gtttattctctaacctgtggcaatgtgctgtagtcagcccgacttatgctactgtcatggacagtgctaataataatactgccttttgctggagatgttagttctcacttatgcattttaagaccttttgctggaagtgttagttcttgcttatc

SEQ ID NO: 3393 - DNA, 37 bp, Homo sapiens; identical to SEQ ID NO: 1048

SEQ ID NO: 3394 - DNA, 27 bp, Homo sapiens
gaaacctctgcgatggtctaacatggc

SEQ ID NO: 3395 - DNA, 94 bp, Homo sapiens
cttttgaattgtttacatcgagatctgcagggtgggataaaggatttgtctaaagaagaaagattatgggaagtacaaagaattttgacagccc

SEQ ID NO: 3396 - DNA, 35 bp, Homo sapiens; identical to SEQ ID NO: 531

SEQ ID NO: 3397 - DNA, 35 bp, Homo sapiens
gaagagattgaacgcctcagagctgagattgctga

SEQ ID NO: 3398 - DNA, 29 bp, Homo sapiens
gagactgaggagtactcctccgagagcga

SEQ ID NO: 3399 - DNA, 83 bp, Homo sapiens
cccagagacggcgtccttgagccaaaagcagctaaagagcagccaaaggcaggcaaggagccggcaaagccatcgcccagcag

SEQ ID NO: 3400 - DNA, 202 bp, Homo sapiens
aggacccgtgcatcttactgtaacccgggggccaggccggctctctcgctgtacattctgtaaaggtgtcttctcttctcagactcttcctctgtcacacgtctgactccttcacgtcaggctcaggttccatgggaggacgaagcagtggacgcattgtgggctttagggacagatgagttttccagatagtgtcagctta

SEQ ID NO: 3401 - DNA, 108 bp, Homo sapiens
ctgggatctctggtaccgtcactcttgcttgtgccttccacaccttctcggtgcagatccctatgggggagctgcctcacgttctctgactggtcagagcagcgcctg

SEQ ID NO: 3402 - DNA, 35 bp, Homo sapiens
tgggtgttccctggcccactctcctctctccttct

SEQ ID NO: 3403 - DNA, 136 bp, Homo sapiens
ttctaaaccacagtctataagcccgagtcaccaggacggcctgtctggccacagacaggggctgcctgtggagcctgcccaccggcccccggcagtgcagtccagcggggaggaggctgcccgttcctgccagttc

SEQ ID NO: 3404 - DNA, 288 bp, Homo sapiens
atccacagaggatgttgttcaaaccagaaatcttttaaacgactgaccttccttaaaaacagaatgactccgattgcttgcttgggctagaatgtacacgtctccttgcctgaataagccatatatatgctcttaaacaaaagtttgaaattatccatatcatctcagtgaacctactggtggactcccaattgacaagattgagcaatagaaaaaaattcctttcctttgaatgatagctgtgattcaccccaccccattttcttgtttctggtccatccgatgaga

SEQ ID NO: 3405 - DNA, 62 bp, Homo sapiens
ctgtgaggagattgagtactctgcagctggcgaggagttggttgaggcacttcttcaaggcc

SEQ ID NO: 3406 - DNA, 92 bp, Homo sapiens
catgctggcggcggcatgcctcccttccacaagcccatgctgctgcagagggagcctgtgtttgcaaaacccagtggactgggctgggtctg

SEQ ID NO: 3407 - DNA, 125 bp, Homo sapiens
tgggaactgcacacaagtccactggcctggcttggccccaggcattgcaattgacagacatttgcatttcatacggtaaatgaggactcagcacagccaaccataatcagcatgtctgggataga

SEQ ID NO: 3408 - DNA, 95 bp, Homo sapiens
tgagtatataactgttaggtgcctccctccagcaccatctcctgagaagcactctcccttgtcgtggaggtgggcaaatctttatcagccactgc

SEQ ID NO: 3409 - DNA, 27 bp, Homo sapiens
tctcctgctacttaaaatcaaaaacta

SEQ ID NO: 3410 - DNA, 250 bp, Homo sapiens
tccctgtgtaggatggcttcccgttattttttttttaagcaaagtaaatgaacatcaaatttccatagtcagctgctgtctttctgcccactgagagctctttggtgaaggcaaagtcctccttcttcattagcggtctcccatgtggggccacatcttccctcaccaggaacccagtgggcgcgctccagcccccctcagcttgccttttgcgtggtcattagagctagggcacacgtcatgctgattc

SEQ ID NO: 3411 - DNA, 123 bp, Homo sapiens
gtaaggatgaatggacggtctttgattggcggcgctggtgacgcccgtcatggtcctgtttggaaggacccttttggaactaaagctggtgacgcagcgcgcagaggcatcgcccggctaagc

SEQ ID NO: 3412 - DNA, 1077 bp, Homo sapiens
cagggtctgatgattttggcgtttccctgcttcccaattgacctggctgtgctgttggctgttcttgcacactcaaggtggttttgccattggcttcctccctcagcctgcctctgggattatgccactgctattcttttttatctaccatcagcacaatgaaatcatcatttttgtcttcaaggtaccaaattctggtgatattggtgctttcttgcagctacttatcatgagaagtgaatggtctcatagtgaacacagtcatggttatagtgttcatacgttccagagacatgtttcctataattatgccctgcacatttttctatcatacaatccttagattacagctctttggttttcaacagctttgtccaattccatctttcccagtttctctaccttgatgaaatatccttcttgcctggttttacatatttaaataacaaattccaaaagtaaagagtatctgaggcagtcacatgacataaggacaaattcaagccatcttggacttgcagagggtggggagaccgtgtcaacacacacaattttaaaaatttcttccctttcaatcttttaaaaacaaaactttttataaaataaaaatgtaatttaaaaaggctacctgtcttggcaagtagctgatcagcctgcattggtgagcaggccattccataacctggtttcttgctccttaattgacagcatggagctaacgtacttaatttcagctctttctacgtgatttgactcattctgttaacattaactgtttttcagtcttctcaactagactgaactccttaagtgcaagaaatacacgcttagtaaatgtttgttggaccagacactgcaccttatgaaattaaagaccagaacattctcatggtagcattacagacactgatggcaaaggtactgtgggatttgggtttggctaataagctctgtggtggtgtttcagaaggaaaatggtgctctcttagttctatggaacatagtggtccagatcttctactgtaaccaggcccaaagctggctaatctggagggctctgccttagggatacttata

SEQ ID NO: 3413 - DNA, 25 bp, Homo sapiens
ggttagagtggacagccccactatg

SEQ ID NO: 3414 - DNA, 78 bp, Homo sapiens
caggtttcgccatgtcaagggagaaggtgcttccccaaagctcttggctatgtcaccggtgacatgaaagaacttgcc

SEQ ID NO: 3415 - DNA, 105 bp, Homo sapiens
aacccgtggtgctccagttcattgactggattctccggggcatatcccaagtggtgttcgtcaacaaccccgtcagtggaatcctgattctggtaggacttcttg

SEQ ID NO: 3416 - DNA, 73 bp, Homo sapiens
catctgggctctatggctacaatgccaccctggtgggagtactcatggctgtcttttcggacaagggagacta

SEQ ID NO: 3417 - DNA, 146 bp, Homo sapiens
agtgcattgaattccatgctcagcaaatgggacctccccgtcttcaccctccctttcaacatggcgttgtcaatgtacctttcagccacaggacattacaatccattctttccagccaaactggtcatacctataactacagctcc

SEQ ID NO: 3418 - DNA, 113 bp, Homo sapiens
gagttggtcagatctatggctgtgataatccatggacagggggcattttcctgggagccatcctactctcctccccactcatgtgcctgcatgctgccataggatcattgctg

SEQ ID NO: 3419 - DNA, 92 bp, Homo sapiens
ttgaggacatctactttggactctggggtttcaacagctctctggcctgcattgcaatgggaggaatgttcatggcgctcacctggcaaacc

SEQ ID NO: 3420 - DNA, 119 bp, Homo sapiens
caatcaaggataagcagtaaaaacggactgcatgaaaaatcagggccagggttctggcttgagcccacttgctgtctaagtgtgtgaacaggacaagtgacgtcccctctctgagagca

SEQ ID NO: 3421 - DNA, 174 bp, Homo sapiens
gttggattgccagcttgtacctggcccttctgtttggccacgctattgttcctcatcatgaccacaaaaaattccaacatctacaagatgcccctcagtaaagttacttatcctgaagaaaaccgcatcttctacctgcaagccaagaaaagaatggtggaaagccctttgtga

SEQ ID NO: 3422 - DNA, 247 bp, Homo sapiens
tgcagccatggtcacgagtcatttctgcctgactgctccagctaacttccagggtctcagcaaactgctgtttttcacgagtatcaactttcatactgacgcgtctgtaatctgttcttatgctcattttgtattttcctttcaactccaggaatatccttgagcatatgagagtcacatccaggtgatgtgctctggtatggaatttgaaaccccaatggggccttggcactaagactggaatgta

SEQ ID NO: 3423 - DNA, 1579 bp, Homo sapiens
gtgtgtgtgacattctctcatgggacaatgttggggtttttcagactgacaggactgcaagagggagaaaggaattttgtcaatcaaaattattctgtattgcaacttttctcagagattgcaaaggattttttaggtagagattatttttccttatgaaaaatgatctgttttaaatgagataaaataggagaagttcctggcttaacctgttcttacatattaaagaaaagttacttactgtatttatgaaatactcagcttaggcatttttactttaacccctaaattgattttgtaaatgccacaaatgcatagaattgttaccaacctccaaagggctctttaaaatcatattttttattcatttgaggatgtcttataaagactgaaggcaaaggtcagattgcttacgggtgttatttttataagttgttgaattccttaatttaaaaaagctcattattttttgcacactcacaatattctctctcagaaatcaatggcatttgaaccaccaaaaagaaataaagggctgagtgcggtggctcacgcctgtaatcccagcactttggggagcccaggcgggcagattgcttgaacccaggagttcaagaccagcctgggcagcatggtgaaaccctgtatctacaaaaaatacaaaaattagccaggcatggtggtgggtgcctgtagttccagctacttgggaggctgaggtgggaaaatgacttgagcccaggaggaggaggctgcagtgagctaagattgcaccactgcactccaacctgggcgacaagagtgaaactgtgtctctcaaaaaaaaaaaaaaacaaacaaaaacaaaaacaaaacaaaacaaaacaaaacaaaacaggtaaggattcccctgttttcctctctttaattttaaagttatcagttccgtaaagtctctgtaaccaaacatactgaagacagcaacagaagtcacgttcagggactggctcacacctgtaatcccagcactttgggagatggaggtaaaaggatctcttgagcccaggagttcaagaccagcttgggcaacatagcaagactccatctcttaaaaaataaaaatagtaacattagccaggtgtagcagcacacatctgcagcagctactcaggaggctgaggtggaaagatcgcttgtgcacagaagttcgaggctgcagtgagctatatgatcatgtcactgcactccagcctgtgtgaccgagcaagaccctatctcaaaaaaattaattaattaattaattaattaatttaaaaaggaagtcatgttcatttactttccacttcagtgtgtatcgtgtagtattttggaggttggaaagtgaaacgtaggaatcctgaagattttttccacttctagtttgcagtgctcagtgcacaatatacattttgctgaatgaataaacagaaatagggaagtaaacctacaaatattttagggagaagctcacttcttccttttctcaggaaaccaagcaagcaaacatatcgttccaattttaaaacccagtgaccaaagcctttggaactatgaatttgca

SEQ ID NO: 3424 - DNA, 221 bp, Homo sapiens
agtgaagaatctaggctgtggctgagagaaccagaggcctctaaaatggacccgagtcgatcttcagaacagggatctaccatgcaggagcttcttgtgctcacacaaatctgtaaatgggaacattgtacattgtcgaatttaaatgatattaattttctcaagctatttttgttactattttcctaaaattgaatatttgcagggagcacttatacttt

SEQ ID NO: 3425 - DNA, 37 bp, Homo sapiens
ttgacttatgcttcctagttcgttgcccagccaccac

SEQ ID NO: 3426 - DNA, 119 bp, Homo sapiens
acttggcgccgtcagcactcgacttgggtttgatcttttcaaagagctgaagaaaacaaatgatggcaacatcttcttttcccctgtgggcatcttgactgcaattggcatggtcctcc

SEQ ID NO: 3427 - DNA, 40 bp, Homo sapiens
actctgaaaaagagacgaagagctcaagaataaaggctga

SEQ ID NO: 3428 - DNA, 26 bp, Homo sapiens
taagaataaaggctgaaggaaaagag

SEQ ID NO: 3429 - DNA, 75 bp, Homo sapiens
cccttaatattgagaagagaccttaggtgtaatggacaataccgctatgatagaactggtaaaggctaatagaca

SEQ ID NO: 3430 - DNA, 77 bp, Homo sapiens
ataagcaaactcactaatgattatgaactgaacataaccaacaggctgtttggagaaaaaacatacctcttccttca

SEQ ID NO: 3431 - DNA, 57 bp, Homo sapiens
catgcatctctggaacctgttgattttgtaaatgcagccgatgaaagtcgaaagaag

SEQ ID NO: 3432 - DNA, 167 bp, Homo sapiens
tcctcagctgataagaggcaaactggatgctaacagaggcatctgaccccagagtctggactcttaaccatgaaccttaatttatccactgggataaataggcgatgggcaaaatgagaacctccccgtcgattctgccagcaaaccctttgtcagcaaggccctca

SEQ ID NO: 3433 - DNA, 83 bp, Homo sapiens
gatggctctattagtagctctaccaagctggtgctggtgaacatggtttattttaaagggcaatgggacagggagtttaagaa

SEQ ID NO: 3434 - DNA, 63 bp, Homo sapiens
ccatataaaaacaacgacctaagcatgtttgtgcttctgcccaacgacatcgatggcctggag

SEQ ID NO: 3435 - DNA, 192 bp, Homo sapiens
ttacgatctagaggcggtcctggctgccatggggatgggcgatgccttcagtgagcacaaagccgactactcgggaatgtcgtcaggctccgggttgtacgcccagaagttcctgcacagttcctttgtggcagtaactgaggaaggcaccgaggctgcagctgccaccggcataggctttactgtcacatc

SEQ ID NO: 3436 - DNA, 1036 bp, Homo sapiens
gtgtttataaccatcctcgaaagtgaaatgtccttttctttgtgccatgcgtaaggtgagtcaaaccaaacctcattgataatctccctttggtttcctttgaaagtaaattggtatcttgtagttttgtgcacacgaaaggagagaaagtctctccagtaaagagtacgaactagtaattttggggggtctctctaattctggtattttgacatgttataatacgcaagtaaaataaaacaatagtttactcagctcatgttactattccccaacagatattgtggcaaatcacacataggaaagagaatttgggaatacagtagcaaaacataaattaaaactcaaatgccaggacaaaataaaacaatataccagatggagaggatgcccgtattttcatcttccattctaacattatccattgttagatgcataagcattttgatattgtgtaataaatgtggtatttgagaagataaatgatgtagttgatcagtattcctcctctatcacctttttagactttgtaaggtaaatatttggactaacttttagaaaagtttccctttttttctccatttacatttttctggtttttttttttttttgagtgaggtacgagtattaccaaatgatattttctgaagatgctttttggaaagctctgaatctatacctaatgctcttaattattggcttgtttcatttttttcctccagtttttaacaagatcacataactggcttatttttaacagctttgtcaaactacaatttacatgccgtaaaatgtacacactgtaattttataattcattgacttttagtaaatttctagcgttatgcatcgccacaatccagttttagaatatttccatgaccctaagaagtttcctcatgtctattaatattcccaatcctaggcaccactgagttgttttctgtctttataagtttttctttctacatcttatataaatggaatcataatacatgtagtattttgtgtctggcgtcttgcacttagcatggtg

SEQ ID NO: 3437 - DNA, 435 bp, Homo sapiens
ttggggagattcctaggctagaaattgctgggccatatgaaaaatcaatagttagctttgtaagaaacagtcaaactgttttccaacgtgacattttatattcccaccaggaatgtttaaaactagtgtcttcaaatcctcaccaacatccaggattgtgtctttatgattatagccatttttgtaggtacaaagtggcatctcatggtggttttaatttgcatttccataatatctaattaggttgagctttttttatgtgcttattggccatttgtttgactttgtttggtgaaatgtatacaaatcatttgctcatttttaatttgggttgtctgtcttgtcttctcattttattgagttaaatgagttcttaataatctctggcttacaagtccttaatttatcaaatatatgatacgtggacatttcctc

SEQ ID NO: 3438 - DNA, 558 bp, Homo sapiens
agactcaactctggcagtggggttcagacatcagacaaattgaggactagctaaaacagggaagagttggaagcacctctccagaagacatgcccaccagtgtgccatatcagtttacccttgccatggctacacccagaagttatggatgaagctgctatggatgaagctggaggacattatgctaagtgaaaagtaatacacaaaaagaaaagtactgaatgatctcacttaaatgtgtaatataaaaaagtcaaatacatagagaaagagaataaaatggtaactatcagggattggggagatgcagggagagggagaaaaaatagagagatataggtcaaaggatccaaagttgaagatatgtaggatgaacgagtctagagctctaacgtacaagacaaggatgatggttaataataatgtattatatataagatttttgtgaaaatagtagatttaaggtgctcttgccacacatacaaaaaggataactatgtgagatgacggatatatgttaatttacttcactagagcaaccatttcactgtgtacatg

SEQ ID NO: 3439 - DNA, 1289 bp, Homo sapiens
aagtcctattattcggccgggcgtggtggctcaggtctgtaatcccagcactttaggaggctgaggaggggagatcacctgaggccaggagttcgagaccagcccagccaacatggtgaaaccctgtctctaccataaattaaaaattagccgggcttggtggtgggcacccgtaatcccacctatttgagaagctgaagcagaagaatcgcttgaacctgggagatggaggttacagtgagccgagattgcgccactgcactccagcctgggtgacagagcaagactctgtcttaagaaaaatttaaaaataggccgggcatggtggctcatgcctgtcatcctagcactttgggaggccaaggcaggtggatcacttgaggtcaggagaccagcccggccaacatggtgaaaccccatctctactaaaaatacaaaaattagctggaaatcgcttgaacctgggaggtggaggttccagtgagccgagatcgtggcactgcactccaacctgagcaacagagtgagacaccagctcaaaaaaaattttttaataataataaaagtcctattattcaactggttatgtacattatggttgaaagggaacgttttaatccagtctcaatccagggcaatagaattacaaagcatgttgtatttcagttcaaatggtattgtattataaaattacagttacattttcctttcggtgatcttcagcataatttcccagaggcccctttttcctccctataggccatcttattaacagattttaaaatttatagtaatgacaaatgacttatcagtgttcatcatctgaaagctaagtggttcgttcaatcactttttcaaagttgatagtagattgcatggtttcatgtttcctcatattggtttattaattctatttaatcaaggaaaataacttcagattccataaagtttcagtttatttttagtttactactaggtgagatagcacattacatacttttactatcaaatattattttagcagcttcccatagtaccaaatgatttgattccctactctcattttttaaagcatataaatatttatgggcttaaaaagggggtttttaaaaactgaggatatcagtaataaattgcagaatattttgcaaagctttcttttggaaagcaaacttttgtgcctgcctatatgcaaagtattttatcagggacttgaacaaagacctcactctttttcacttgtcttatgtcgagagaaaaggttattggcagccacattcctaagactg

SEQ ID NO: 3440 - DNA, 43 bp, Homo sapiens
acaaagcacgtctatttttttatgaaagactctcaggactttg

SEQ ID NO: 3441 - DNA, 25 bp, Homo sapiens
gtacaggcgcaccggggacagctga

SEQ ID NO: 3442 - DNA, 178 bp, Homo sapiens
cagaagcatcgcaagcggttgaaggcggaggagcagtggcagcgacggcagcaggtgttccgccggggcgtgtcaacgcggcgctcggcctacgccttctcgcaccagcggggctacgcggacctcatctcctccgggcgcagcatccgcaagaagcgctcgccgcttgatgccatcg

SEQ ID NO: 3443 - DNA, 83 bp, Homo sapiens
tggttaactatcatcctggctgttgctgtgtgcttactacccgtcgttgccattcgattcctgtcaatgaccatctggccatc

SEQ ID NO: 3444 - DNA, 127 bp, Homo sapiens
ggcttggatacttcttattggacttttgtgaatgctttttcaatttttggaagcattgcactttattttggcatcatgtttgactttcatagtgctggaatacatgttctctttccatctgcatttc

SEQ ID NO: 3445 - DNA, 198 bp, Homo sapiens
tgagcctccgattccctgggttatacatagtgggacaaagagacttactattcaactataagagattctttgtaagcttgttgcatggggtcctaacatcgatgatcctcttcttcatacctcttggagcttatctgcaaaccgtagggcaggatggagaggcaccttccgactaccagtcttttgccgtcaccattg

SEQ ID NO: 3446 - DNA, 160 bp, Homo sapiens
cgagtgactattcctttgctcagttccgatatctgcagaggctactgctggtgcatggccgatggtcttacataaggatgtgcaagttcctacgatacttcttttacaaaaactttgcctttactttggttcatttctggtactccttcttcaatggcta

SEQ ID NO: 3447 - DNA, 36 bp, Homo sapiens
gcccacattggcgttggaataagtggacaagaagga

SEQ ID NO: 3448 - DNA, 174 bp, Homo sapiens
tgaaattcttctcgagaaaaagaccaagagaaataagattctgaagctgaagttcccaagaacagaagaagaaagacggatgcggacccaaagtaaaaggaggctagaagctaagaaagagcagcggcagaaaaactttgtggacctggcctgcgagtgcagcgcagtcatctg

SEQ ID NO: 3449 - DNA, 98 bp, Homo sapiens
atagaggtggcgtctacgcaaagtttgcacctcctgtgcaggaatctttttttccacccggtggaaaccgtgccttaatcatcactggttcttggttg

SEQ ID NO: 3450 - DNA, 39 bp, Homo sapiens
aaatataggatttgcttgtgaacttctgactgaagacac

SEQ ID NO: 3451 - DNA, 103 bp, Homo sapiens
gctacagctattgaagacaagctacaggatggagttccagaaaccatttcaaaacttgcaaaagctgacattaagatctgggtgcttactggagacaaaaagg

SEQ ID NO: 3452 - DNA, 40 bp, Homo sapiens
tccaccaaccgggacgaagctctggataaagtatatgagg

SEQ ID NO: 3453 - DNA, 44 bp, Homo sapiens
tctttgcaaatgaaactcttagaaccctatgcctttgctacaag

SEQ ID NO: 3454 - DNA, 88 bp, Homo sapiens
aggcaatatcaagctttactgtaaaggtgctgacactgttatttatgaacggttacatcgaatgaatcctactaagcaagaaacacag

SEQ ID NO: 3455 - DNA, 153 bp, Homo sapiens
gaaggtgccctggtaaacgctgccaggaactttggctttgccttcctcgccaggacccagaacaccatcaccatcagtgaactgggcactgaaaggacttacaatgttcttgccattttggacttcaacagtgaccggaagcgaatgtctatc

SEQ ID NO: 3456 - DNA, 70 bp, Homo sapiens
gaaagagccagaagtacgacagttcttcttcttgctcgcagtttgccacacagtcatggtggataggact

SEQ ID NO: 3457 - DNA, 29 bp, Homo sapiens
tcgggatgcctctcaacacaaccacaaca

SEQ ID NO: 3458 - DNA, 116 bp, Homo sapiens
gggacctgcaaatgtactatgctgagaaggacacacccgcaaaagctagaaccaccacactcaatgaacagctcgggcagatccattatatcttctctgataagacggggacactc

SEQ ID NO: 3459 - DNA, 132 bp, Homo sapiens
ctggtcttgccatcggccatgcttattgggaagcacaggtgggcaattcctcttggtacctctatgatggagaagacgatacaccctcctaccgtggattcctcattttctggggctatatcattgttctca

SEQ ID NO: 3460 - DNA, 38 bp, Homo sapiens
gaacaccgatttctgccacggcttagtcatttttgcag

SEQ ID NO: 3461 - DNA, 108 bp, Homo sapiens
ttgaatgtgaagaacccaataacagactagataagtttacaggaacactattttggagaaacacaagttttcctttggatgctgataaaattttgttacgtggctgtg

SEQ ID NO: 3462 - DNA, 26 bp, Homo sapiens
tttaagatgtcacttgaaatcacaga

SEQ ID NO: 3463 - DNA, 42 bp, Homo sapiens
gtctagctctgagcctaacagcctctgctatgtggaaacagc

SEQ ID NO: 3464 - DNA, 34 bp, Homo sapiens
aattcaagttggagacgtcattcgtctgaaaaaa

SEQ ID NO: 3465 - DNA, 37 bp, Homo sapiens
aggaaatcaacaataggacgtgtgaagtcattaagga

SEQ ID NO: 3466 - DNA, 69 bp, Homo sapiens
ttaaaacatacaagtacaacgcatttacctttataccaatgaatctgtttgagcagtttaagagagcag

SEQ ID NO: 3467 - DNA, 78 bp, Homo sapiens
ggcaagtcaaagcaaacgatcgcaagtaccacgaacaacctcactttatgaacacaaaattcttgtgtattaaggaga

SEQ ID NO: 3468 - DNA, 114 bp, Homo sapiens
acatttgacgaggattctcagcctaatgacgaagtggttccctacagtgatgatgaaacagaagatgaacttgatgaccaggggtctgctgttgaaccagaacaaaaccgagtc

SEQ ID NO: 3469 - DNA, 132 bp, Homo sapiens
gcttgatcaccccagtgtactccagcctaggtgacagagcaagaacttgaatcaacaaccaaaaaaaaaaaaaaaaaggaagaaaaaagaagcaaaccacctcatgtgtatgccacactcacaggaaattaa

SEQ ID NO: 3470 - DNA, 30 bp, Homo sapiens
atgccccagccggggcccagcgaacgccag

SEQ ID NO: 3471 - DNA, 47 bp, Homo sapiens
tttagaaaatgttcacctagaggtgttctggtaaactgattgctggc

SEQ ID NO: 3472 - DNA, 151 bp, Homo sapiens
tgaatatcttcaatggggatgcagacctctcaggcatgacctggagccacggtctctcagtatctaaagtcctacacaaggcctttgtggaggtcactgaggagggagtggaagctgcagctgccaccgctgtagtagtagtcgaattatc

SEQ ID NO: 3473 - DNA, 151 bp, Homo sapiens; identical to SEQ ID NO: 3472

SEQ ID NO: 3474 - DNA, 39 bp, Homo sapiens
gaaataccatacaaaggcaaagatctaagcatgattgtg

SEQ ID NO: 3475 - DNA, 39 bp, Homo sapiens; identical to SEQ ID NO: 3474

SEQ ID NO: 3476 - DNA, 26 bp, Homo sapiens
attcctttaattttgccttgctggag

SEQ ID NO: 3477 - DNA, 26 bp, Homo sapiens
attcctttaattttgccttgctggag

SEQ ID NO: 3478 - DNA, 41 bp, Homo sapiens
tggcaatgatacgacactggttcttgtgaacgcaatctatt

SEQ ID NO: 3479 - DNA, 41 bp, Homo sapiens; identical to SEQ ID NO: 3478

SEQ ID NO: 3480 - DNA, 112 bp, Homo sapiens
ttagatgccatcaagaaattttaccagaccagtgtggaatctactgattttgcaaatgctccagaagaaagtcgaaagaagattaactcctgggtggaaagtcaaacgaatg

SEQ ID NO: 3481 - DNA, 112 bp, Homo sapiens; identical to SEQ ID NO: 3480

SEQ ID NO: 3482 - DNA, 56 bp, Homo sapiens
gtttcaaaagcttctgactgaattcaacaaatccactgatgcatatgagctgaaga

SEQ ID NO: 3483 - DNA, 56 bp, Homo sapiens; identical to SEQ ID NO: 3482

SEQ ID NO: 3484 - DNA, 25 bp, Homo sapiens
tcagctttagatccctgaacaggtc

SEQ ID NO: 3485 - DNA, 25 bp, Homo sapiens
tcagctttagatccctgaacaggtc

SEQ ID NO: 3486 - DNA, 25 bp, Homo sapiens
cacagaaaaagctgcaacatatcat

SEQ ID NO: 3487 - DNA, 25 bp, Homo sapiens
cacagaaaaagctgcaacatatcat

SEQ ID NO: 3488 - DNA, 25 bp, Homo sapiens
caacactgcacaacaaattagcaag

SEQ ID NO: 3489 - DNA, 25 bp, Homo sapiens
caacactgcacaacaaattagcaag

SEQ ID NO: 3490 - DNA, 33 bp, Homo sapiens
ttcattccacagacacacacagcctctctgccc

SEQ ID NO: 3491 - DNA, 33 bp, Homo sapiens; identical to SEQ ID NO: 3490

SEQ ID NO: 3492 - DNA, 42 bp, Homo sapiens
aaaatgttcacctgcagatgttctggtaaactgattgctggc

SEQ ID NO: 3493 - DNA, 45 bp, Homo sapiens
taggattcggatcatcacctacttcaactaatgaagagttccatt

SEQ ID NO: 3494 - DNA, 81 bp, Homo sapiens
atggtggatatcttcaatggggatgcagacctctcaggcatgaccgggagccgcggtctcgtgctatctggagtcctacac

SEQ ID NO: 3495 - DNA, 109 bp, Homo sapiens
aattgatggaatggacaagtttgcagaatatgagagagacacgtgtcgatttacacttacctcggttcaaagtggaagagagctatgacctcaaggacacgttgagaac

SEQ ID NO: 3496 - DNA, 109 bp, Homo sapiens; identical to SEQ ID NO: 3495

SEQ ID NO: 3497 - DNA, 39 bp, Homo sapiens; identical to SEQ ID NO: 3474

SEQ ID NO: 3498 - DNA, 39 bp, Homo sapiens; identical to SEQ ID NO: 3474

SEQ ID NO: 3499 - DNA, 41 bp, Homo sapiens
tgatgaggcaatacacatcttttcattttgcctcgctggag

SEQ ID NO: 3500 - DNA, 48 bp, Homo sapiens
gtaatattggcagcaataccacattggttcttgtgaacgcaatctatt

SEQ ID NO: 3501 - DNA, 57 bp, Homo sapiens
atgctccagaagaaagtcgaaagaagattaactcctgggtggaaagtcaaacgaatg

SEQ ID NO: 3502 - DNA, 57 bp, Homo sapiens; identical to SEQ ID NO: 3501

SEQ ID NO: 3503 - DNA, 56 bp, Homo sapiens; identical to SEQ ID NO: 3482

SEQ ID NO: 3504 - DNA, 56 bp, Homo sapiens; identical to SEQ ID NO: 3482

SEQ ID NO: 3505 - DNA, 26 bp, Homo sapiens
ccacaggaaaagctgcaacatatcat

SEQ ID NO: 3506 - DNA, 27 bp, Homo sapiens
tgttcgacctgttccaacagttcagaa

SEQ ID NO: 3507 - DNA, 42 bp, Homo sapiens
gaggagaggcataaattcaggatctcacccttcattccacag

SEQ ID NO: 3508 - DNA, 27 bp, Homo sapiens
gccttgaggaacagctgcctctagagt

SEQ ID NO: 3509 - DNA, 30 bp, Homo sapiens
ggtgctgagagccgggactcacaaccaaag

SEQ ID NO: 3510 - DNA, 130 bp, Homo sapiens
aaatatgatatgtcaggtgcccgcctggccctaatactgtgtgtcaccaaagcccgggaaggttccgaagaagacctggatgctctggaacacatgtttcggcagctgagattcgaaagcaccatgaaaa

SEQ ID NO: 3511 - DNA, 30 bp, Homo sapiens
caattccaggaagagctggaaaaattccag

SEQ ID NO: 3512 - DNA, 192 bp, Homo sapiens
caggccatcgattcccgggaagatcccgtcagttgtgccttcgtggtactcatggctcacgggagggaaggcttcctcaagggagaagatggggagatggtcaagctggagaatctcttcgaggccctgaacaacaagaactgccaggccctgcgagctaagcccaaggtgtacatcatacaggcctgtcga

SEQ ID NO: 3513 - DNA, 45 bp, Homo sapiens
tacctttctctctgactttgcctcctcctcttcttgttgtttcag

SEQ ID NO: 3514 - DNA, 67 bp, Homo sapiens
ggtcatcaaagacagcccacaaaccatcccaacatacacagatgccttgcacgtttattccacggta

SEQ ID NO: 3515 - DNA, 31 bp, Homo sapiens
gaaaggctcatgctttatccagaccctggtg

SEQ ID NO: 3516 - DNA, 105 bp, Homo sapiens
gtgacccggcggatggcagaagcagagctggttcaagaaggaaaagcaaggaaaacgaaccctgaaatccaaagcaccctccggaaacggctgtatctgcagtag

SEQ ID NO: 3517 - DNA, 151 bp, Homo sapiens
cttccagcattctttctgtctcacagaaatttagaggcagctcttacctctccccaagatcttctgttcccaaggccaaatggcacccagtttcttttccatcacacccttcatgcaggtcctcctgtccttattagagcaagccagccaa

SEQ ID NO: 3518 - DNA, 600 bp, Homo sapiens
actccgttctcttcctagctcatggcctctctagataataaagttgtctcctcctttctggatctcttcctcctaacacccctcccctgaaaccctggactctgccctctctccaagaaaatccatctattcaactattcttgcattcaattactctaaatgagagcgtgttggagctatggcaaattccctgttgtcaccttgctattttgcagacaacataatatttaacctctcataaccagagaggttaaataatttgtcaaatgcaatacagtaagacagaggcaaggacaaggtttgacttccagcccagcctcttttccacaacctgctaaatcctgatccatctgaaaacttttctaattagtgaagatgactaataaaaattttccctatctccaaggtaggagctttctggaagtttctagaaattttcaataaccaccagccaaggttacctccaggtaaccttgcagcaccaggctggaagtcagatcggcttcactatcttccaactctacagcctgtatctctccatccccagctttgacctttcctgctcaagtaacctacgggcacatccagcgtcactaaaaa

SEQ ID NO: 3519 - DNA, 195 bp, Homo sapiens
taagcctttgctatcaccatttcccccaagctggagggccctccctctccctttacccctcttccactacctcccacccctactttttccagaaagccatttcctctcttttttctgattgatccttccctctcacccaggattagatgctggaaatgaccacttctggagggcagggaacaagcccttaatctg

SEQ ID NO: 3520 - DNA, 40 bp, Homo sapiens
ccgccgcctggttaaaggcgcttatttcccaggcagccgc

SEQ ID NO: 3521 - DNA, 152 bp, Homo sapiens
ccctgaagaagtccaatgcaccgcttgtcaatgtgaccctctactatgaagcactgtgcggtggctgccgagccttcctgatccgggagctcttcccaacatggctgttggtcatggagatcctcaatgtcacgctggtgccctacggaaac

SEQ ID NO: 3522 - DNA, 53 bp, Homo sapiens
gcctgcgtgttggatgaacttgacatggagctagccttcctgaccattgtctg

SEQ ID NO: 3523 - DNA, 131 bp, Homo sapiens
agggctgtcgccagacactatcatggagtgtgcaatgggggaccgcggcatgcagctcatgcacgccaacgcccagcggacagatgctctccagccaccacacgagtatgtgccctgggtcaccgtcaatg

SEQ ID NO: 3524 - DNA, 344 bp, Homo sapiens
agaatctttttagccctcagcttgacactcatagtcccatggagtcagggatggacaagacagagggaccagagataaaggaacccaggcggaggttgcagtgagctgagatcatgccactgcactccagcctgggcaacaagagcaaaacttgatagctttgcatagggaaagagggcattgatgctggggttttgaaaggtgagtaggagtccatcaggcaaaaaaagtatgtattaattcgaagtattaaacatccctagccacccccattgggaaagatgtgccactgatttgcgaggcgggaggcgggggccagacttgggaatatgtgcagccctttc

SEQ ID NO: 3525 - DNA, 27 bp, Homo sapiens
aaacccttggaagatcagacccagctc

SEQ ID NO: 3526 - DNA, 27 bp, Homo sapiens
caagaagccggatgtctgcccttcctc

SEQ ID NO: 3527 - DNA, 38 bp, Homo sapiens
ggccggtgagctgcggagagctcatggaaggcgagtgg

SEQ ID NO: 3528 - DNA, 46 bp, Homo sapiens
tcggcacctgctacttaccaactggaaaattttatgcatcccatga

SEQ ID NO: 3529 - DNA, 65 bp, Homo sapiens
cagatacacaaaattccaccccatgatcaagaatcctgctccactaagaatggtgctaaagtaaa

SEQ ID NO: 3530 - DNA, 30 bp, Homo sapiens
tcattgcaatttagagatgtggctgtagaa

SEQ ID NO: 3531 - DNA, 62 bp, Homo sapiens
gtattattgtctctaagccagacctgatcacctgtctggagcaaggaataaaacctctgact

SEQ ID NO: 3532 - DNA, 27 bp, Homo sapiens
ttgaaatatatagaaggtgacaaagct

SEQ ID NO: 3533 - DNA, 531 bp, Homo sapiens
agtacttctctagctttactacacataagaaaattcatagtggagagaaaccctacatttgtgaagaatgtggcaaagcctttatgtacccctatacccttactacacataagataatccatactggagagcaaccctacaaatgtaaagaatgtgacaaagcttttaaccatcctgcaactctttcttcacataagaaaattcatactggagagaaaccgtacacgtgtgataaatgtggcaaagcctttatttcatcctcgatccttagtaaacatgagaagattcatacgggagagaaaccctacaaatgtgaagaatgtggcaaagccttcacccgctcctcacaccttactatgcataagataattcatactggagagaaaccatacaaatgtgaagaatgtggcaaagcctttacatggtctgcaggcctccataaacataggagaactcatactggagagaaaccctacaaatgtgaagaatgtggcaaagcgtatactacatcctcaaatctaactgaacata

SEQ ID NO: 3534 - DNA, 193 bp, Homo sapiens
ggttcataaaagagcaattactgtgacaaaaatctttcagaaaatataagcctttaaggtgaagaagagtattgattctgaagacaagcattacaaatataaagaggtttgtagtacctttgcttgtattacagatcttattgcccgcgttttgtattagaaggaaaccctaaagcggttgccaaactttgtg

SEQ ID NO: 3535 - DNA, 244 bp, Homo sapiens
tgagatcagactgaccaaaacggagaaacccagtctctactgaaaatataaaattagccatgcatggtggcacatgcctgtaatcccagctactcaggaggcttgaaccctggaggcagaggttgtggtgagtcgagatcattgcactccagcctgggcaataagagtgaaactctgtctccaggaaaaaaaaaaatttatttgtgtataactttaaaagcagatttttggaagcattgtaatt

SEQ ID NO: 3536 - DNA, 147 bp, Homo sapiens
gtccctgtttgctgagaccatatgggtgacagccgaccagtaccgtgtatacccactgatgggagtctcaggcaaggatgacgtcttcgctggtgcctggattgccatcttctgcggcttctccttcttcatggtagccagttttgg

SEQ ID NO: 3537 - DNA, 70 bp, Homo sapiens
tggtgctcatgctcatcgtctacatcttcgagtgcgcctcctgcatcacgtcctacacccaccgtgacta

SEQ ID NO: 3538 - DNA, 105 bp, Homo sapiens
atggtgtccaacccatccctgatcaccaagcagatgctgaccttctacagcgcggacaccgaccagggccaggagctgacccgcctctgggaccgcgtcatgatt

SEQ ID NO: 3539 - DNA, 173 bp, Homo sapiens
agaatgctgtggcacatctggtcccatggactgggtgaacttcacgtcagccttccgggcggccactccggaggtggtgttcccctggcccccactgtgctgtcgccggacgggaaacttcatccccctcaacgaggagggctgccgcctggggcacatggactacctgttca

SEQ ID NO: 3540 - DNA, 37 bp, Homo sapiens
acgccatcgacagctacacgtggggtatctcgtggtt

SEQ ID NO: 3541 - DNA, 26 bp, Homo sapiens
gatagccatgtatttctacaccatgc

SEQ ID NO: 3542 - DNA, 40 bp, Homo sapiens
gaggggaaggcaacatacacaccccggactcctccgcatc

SEQ ID NO: 3543 - DNA, 48 bp, Homo sapiens
ccacttccaagatctttttccaggttcctgagccctactgtgtctcag

SEQ ID NO: 3544 - DNA, 92 bp, Homo sapiens
gtgcacatatccttagcccatctttcaagggacctctccatgatcccacctcccattcacagatacctctcttgtagctctctgacctcctc

SEQ ID NO: 3545 - DNA, 28 bp, Homo sapiens
gcatcgccattcttgctgaaccgtttgt

SEQ ID NO: 3546 - DNA, 93 bp, Homo sapiens
tctggaagcctctattgccatgagagttctgtcacggtcactttactgtccccatcatcacccagcacggggctaagcatatactagatagtc

SEQ ID NO: 3547 - DNA, 30 bp, Homo sapiens
cccatgactccttacctgatgctgtgccag

SEQ ID NO: 3548 - DNA, 195 bp, Homo sapiens
agatgtggggacaagttctacgaccccctgcagcactgttgctatgatgatgccgtcgtgcccttggccaggacccagacgtgtggaaactgcaccttcagagtctgctttgagcagtgctgcccctggaccttcatggtgaagctgataaaccagaactgcgactcagcccggacctcggatgacaggctttgt

SEQ ID NO: 3549 - DNA, 252 bp, Homo sapiens
ttctgtgacctgtctgaggcccaccctgcagctgccctgaggaggcccacaggtccccttctagaattctggacagcatgagatgcgtgtgctgatgggggcccagggactctgaaccctcctgatgacccctatggccaacatcaacccggcaccaccccaaggctggctggggaacccttcacccttctgtgagattttccatcatctcaagttctcttctatccaggagcaaagcacaggatcataata

SEQ ID NO: 3550 - DNA, 67 bp, Homo sapiens
ccttccaagcccatcccgactcccggggccctcagacaccccgatcctcccacaataaaggcttctc

SEQ ID NO: 3551 - DNA, 34 bp, Homo sapiens
ctgccgctgtcgtctttgcttcagccgcagtcgc

SEQ ID NO: 3552 - DNA, 77 bp, Homo sapiens
cccgcggggttaagatcacacacgcgcccacgccggcccgcggggcgtgcactttcgctgggttccgtccgccgcag

SEQ ID NO: 3553 - DNA, 34 bp, Homo sapiens
tgctgggttccacgccacgttcctgtctccgcag

SEQ ID NO: 3554 - DNA, 62 bp, Homo sapiens
cgttcgatccctagagggaggagcctgtccaaacggacgctaacggcctacctccccctcag

SEQ ID NO: 3555 - DNA, 49 bp, Homo sapiens
tgctcttacagcctgttccaagtgtggcttaatccgtctccaccaccag

SEQ ID NO: 3556 - DNA, 208 bp, Homo sapiens
atgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgt

SEQ ID NO: 3557 - DNA, 47 bp, Homo sapiens
ttctccgtgaccctgatcatcctcatcgtggagctgtgcgggctcca

SEQ ID NO: 3558 - DNA, 271 bp, Homo sapiens
ctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatc

SEQ ID NO: 3559 - DNA, 106 bp, Homo sapiens
cctcggcgctcgagagatgtaagctgcagccgcagccatgcctactacgtgtgtgcctgggaccgccgactggctgtggccatcctgacggccatcaacctactgg

SEQ ID NO: 3560 - DNA, 42 bp, Homo sapiens
atgtggctgacctggtgcactctgcccacctggtttttgtca

SEQ ID NO: 3561 - DNA, 168 bp, Homo sapiens
atggagtacttctttcctccgcctttcctctgttttcctcttcctgtctcccctccctcccacctttttctttccttcccaattccttgcactctaaccagttcttggatgcatcttcttccttccctttcctcttgctgtttccttcctgtgttgttttgttgccca

SEQ ID NO: 3562 - DNA, 149 bp, Homo sapiens
ttgcctgtcggctttcttatctgcctgttttgcaagcaccttctcctgtgtccttgggagccctgagacttctttctctccttgcctccacccacctccaaaggtgctgagctcacatccacaccccttgcagccgtccatgccacagc

SEQ ID NO: 3563 - DNA, 34 bp, Homo sapiens
ggaggaaggtgtgcagtgtacttcccctttaaat

SEQ ID NO: 3564 - DNA, 33 bp, Homo sapiens
atttggaggtcagtaatttccaatgggcgggag

SEQ ID NO: 3565 - DNA, 78 bp, Homo sapiens
gtccctaggccccgcctggcactcagccttgccagagattggctccagaatttttgccaggcttacagaacacccact

SEQ ID NO: 3566 - DNA, 26 bp, Homo sapiens
aactattctctgtggtatcaaaaaga

SEQ ID NO: 3567 - DNA, 416 bp, Homo sapiens
ggccctctgtgttaagaataacgtgtcctgctttggcagagagaagaaaatagccactgcccgctttcaaggcaagatcgaccttttctgttttgttttgtttttctttctttttcctggccatgaggacaaaaattactgagtggcccttaaagagggaagtttgttttcagctgttctcttttgcccgtaggtgggagggtggggattgctgcgtcctagctagaggaatggctttgcttgaatgtgtagtgcacacgcacgggtgtttctgtgtgctagttgcttcttgctgctgcttcctgcttgtctgggactcacatacataacgtgatatatatatatatatatataaatgtataaatatatattttatttttttttaaatccctggagcttctggttcctatcagttc

SEQ ID NO: 3568 - DNA, 99 bp, Homo sapiens
ctacatcatcgggaaggacacttgggtggagcactggcccgaggaggacgaatgccaagacgaagagaaccagaaacaatgccaggacctcggcgcctt

SEQ ID NO: 3569 - DNA, 82 bp, Homo sapiens
tgagtgctttccctgcgcgtgcgcgcgaccgcccgactgccccgcccatgccacgcccacaccattgtcacgcccctgcgcc

SEQ ID NO: 3570 - DNA, 113 bp, Homo sapiens
aggttggacagcagcgcacgttcatcagccccatcaagtgcagagaagccctgaagctggaggagaagaaacactacctcatgtggggtctctcctccgatttctggggagag

SEQ ID NO: 3571 - DNA, 60 bp, Homo sapiens
ttcagctgtccaatgactttgacgagtacatcatggccattgagcagaccatcaagtcag

SEQ ID NO: 3572 - DNA, 25 bp, Homo sapiens
gtgagttccctggagccgggaacag

SEQ ID NO: 3573 - DNA, 82 bp, Homo sapiens
aagctgtacccggttctaccatccggaaaaggaggatggaaagctgaacaagctctgccgtgatgaactgtgccgctgtgct

SEQ ID NO: 3574 - DNA, 31 bp, Homo sapiens
tctgatggttccaggggcctgagagtcccag

SEQ ID NO: 3575 - DNA, 103 bp, Homo sapiens
ctcacactctgaggatgactgtctagctttcaaagttcaccaatactttaatgtagagcttatccagcctggagcagtcaaggtctacgcctattacaacctg

SEQ ID NO: 3576 - DNA, 41 bp, Homo sapiens
tatgtctatattggacatatccatgatgactggctttgctc

SEQ ID NO: 3577 - DNA, 700 bp, Homo sapiens
gcagggtcaacatcaccatagtctgctattctttgataactccatttatgctgtctttgaagttcacttctggcattatcacttttcatttctttgctgcatttttatctttgttggccagttccctcttttcgtgatacattgttgtaaaatctcatgggagttagccacctggagacagggaggcaacagaactacacactttgctgtctgtgcataaattgaagagcagaagctcagtgaccaatcactgatggactttgaaaggagtgacagtaattggccctcaattatgatgcttatcttttatttatgtcgtgatttctagactgaagagttagcaacaaagtttataccatatgcaactactcgtgatcaatataccaaggtactgaaaaagaaccatgtcactgggctactagtgttatttaactgaatcatgcagagtgagggctgcctgtattcttgccttgttttctagaactgaagcatggagggtcaaataatgcatccaatgttatttagagctggaatttgaatccatgcagttgggtgcagagtctgagctcttaatcaccttgaccattacattaccttgctttttatttcctttggggaaatgtttcctaaaaaatgtaacgcccctctgtgctgctatgtgggaatcagaagtctcagtgcctgatcagacctccttgtc

SEQ ID NO: 3578 - DNA, 118 bp, Homo sapiens
taagaagctaggtcaccggggttcatcttggccatccctctatctctagcaagaattcttgcaaataatatccatgatattcagtactttccaagtacactgtgtatctgatactgtt

SEQ ID NO: 3579 - DNA, 51 bp, Homo sapiens
aaagaggcctcaggatgccaagaacactatgatccttgagatctgtaccag

SEQ ID NO: 3580 - DNA, 75 bp, Homo sapiens
catgctaaggccaaagatcaactcacctgtaataaattcgacctcaaggtcaccataaaaccagcaccggaaaca

SEQ ID NO: 3581 - DNA, 25 bp, Homo sapiens
aggaaaaggccaaggcaccttgtcg

SEQ ID NO: 3582 - DNA, 156 bp, Homo sapiens
accttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagag

SEQ ID NO: 3583 - DNA, 42 bp, Homo sapiens
cgttggctcaatgaacagagatactacggtggtggctatggc

SEQ ID NO: 3584 - DNA, 86 bp, Homo sapiens
ataagaaccgctgggaggaccctggtaagcagctctacaacgtggaggccacatcctatgccctcttggccctactgcagctaaaa

SEQ ID NO: 3585 - DNA, 274 bp, Homo sapiens
gccaagctgagatggatagtcctaaggtatcaagctgggatgcataaccctgagctgagctgggatgcacggctctaagttttcgcaggtcctcattgtaaaccacacgagaaagtttgttgcgtcatttattcaacaaatgcgtattaagcattcatttcaaagggagaagtgagagttgatgaaacaagagaggtaaggcaggagccaagtaattgagagcctcgaatgtcagccaggacacccaaacaccaggaagtctagcatgcatctc

SEQ ID NO: 3586 - DNA, 117 bp, Homo sapiens
ccttgaagccaactacatgaacctacagagatcctacactgtggccattgctggctatgctctggcccagatgggcaggctgaaggggcctcttcttaacaaatttctgaccacagc

SEQ ID NO: 3587 - DNA, 152 bp, Homo sapiens
ccgcctacgtggtcaaggtcttctctctggctgtcaacctcatcgccatcgactcccaagtcctctgcggggctgttaaatggctgatcctggagaagcagaagcccgacggggtcttccaggaggatgcgcccgtgatacaccaagaaatg

SEQ ID NO: 3588 - DNA, 44 bp, Homo sapiens
agctctgcctttgcggccttcgtgaaacgggcacccagcacctg

SEQ ID NO: 3589 - DNA, 115 bp, Homo sapiens
cgcggaacggctgaagcacctcattgtgaccccctcgggctgcggggaacagaacatgatcggcatgacgcccacggtcatcgctgtgcattacctggatgaaacggagcagtgg

SEQ ID NO: 3590 - DNA, 54 bp, Homo sapiens
tgcagacctcagtgaccaagtcccggacaccgagtctgagaccagaattctcct

SEQ ID NO: 3591 - DNA, 38 bp, Homo sapiens
acaaaactgtggctgttcgcaccctggatccagaacgc

SEQ ID NO: 3592 - DNA, 142 bp, Homo sapiens
caagaggcgtcaccagcagaccgtaaccatcccccccaagtcctcgttgtccgttccatatgtcatcgtgccgctaaagaccggcctgcaggaagtggaagtcaaggctgctgtctaccatcatttcatcagtgacggtgtc

SEQ ID NO: 3593 - DNA, 46 bp, Homo sapiens
gggtaggtagcctgttgcacacacacttgcccggatcctttctctc

SEQ ID NO: 3594 - DNA, 40 bp, Homo sapiens
gtggaaatccgagccgttctctacaattaccggcagaacc

SEQ ID NO: 3595 - DNA, 86 bp, Homo sapiens
ctgtgtggcagaccccttcgaggtcacagtaatgcaggacttcttcatcgacctgcggctaccctactctgttgttcgaaacgagc

SEQ ID NO: 3596 - DNA, 88 bp, Homo sapiens
ttgcagaagagaacatcgtttcccgaagtgagttcccagagagctggctgtggaacgttgaggacttgaaagagccaccgaaaaatgg

SEQ ID NO: 3597 - DNA, 89 bp, Homo sapiens
gacggcatgcgggagaaccccatgaggttctcgtgccagcgccggacccgtttcatctccctgggcgaggcgtgcaagaaggtcttcct

SEQ ID NO: 3598 - DNA, 41 bp, Homo sapiens
gacgccgttccgtgcagctcacggagaagcgaatggacaaa

SEQ ID NO: 3599 - DNA, 63 bp, Homo sapiens
aggattacgccggtgtcttctccgacgcagggctgaccttcacgagcagcagtggccagcaga

SEQ ID NO: 3600 - DNA, 142 bp, Homo sapiens
ccagtcagaagaccggcagcctgtacctgggcagcagatgaccctgaagatagagggtgaccacggggcccgggtggtactggtggccgtggacaagggcgtgttcgtgctgaataagaagaacaaactgacgcagagtaag

SEQ ID NO: 3601 - DNA, 190 bp, Homo sapiens
aacaagggcaggctgttgaaggcgggacgccaggtgcgagagcccggccaggacctggtggtgctgcccctgtccatcaccaccgacttcatcccttccttccgcctggtggcgtactacacgctgatcggtgccagcggccagagggaggtggtggccgactccgtgtgggtggacgtcaaggactcct

SEQ ID NO: 3602 - DNA, 34 bp, Homo sapiens
catcccggatccctccctgcgttccctgccactc

SEQ ID NO: 3603 - DNA, 154 bp, Homo sapiens
aggctaccaggaccatgcaggctctgccctacagcaccgtgggcaactccaacaattacctgcatctctcagtgctacgtacagagctcagacccggggagaccctcaacgtcaacttcctcctgcgaatggaccgcgcccacgaggccaagat

SEQ ID NO: 3604 - DNA, 102 bp, Homo sapiens
tgttcgtgacgaaccctgatggctctccagcctaccgagtccccgtggcagtccagggcgaggacactgtgcagtctctaacccagggagatggcgtggcca

SEQ ID NO: 3605 - DNA, 77 bp, Homo sapiens
cccatcgtgacctctccctaccagatccacttcaccaagacacccaagtacttcaaaccaggaatgccctttgacct

SEQ ID NO: 3606 - DNA, 104 bp, Homo sapiens
ttgtgctgagccggaaggtactgctggacggggtgcagaacccccgagcagaagacctggtggggaagtctttgtacgtgtctgccaccgtcatcttgcactca

SEQ ID NO: 3607 - DNA, 80 bp, Homo sapiens
agaaagtggagggaactgcctttgtcatcttcgggatccaggatggcgaacagaggatttccctgcctgaatccctcaag

SEQ ID NO: 3608 - DNA, 83 bp, Homo sapiens
agtttcgaggtcatagtggagcctacagagaaattctactacatctataacgagaagggcctggaggtcaccatcaccgccag

SEQ ID NO: 3609 - DNA, 57 bp, Homo sapiens
ggccagtggaagatccgagcctactatgaaaactcaccacagcaggtcttctccact

SEQ ID NO: 3610 - DNA, 68 bp, Homo sapiens
gtcaagcaggactccttgtcttctcagaaccagcttggcgtcttgcccttgtcttgggacattccgga

SEQ ID NO: 3611 - DNA, 39 bp, Homo sapiens
gtgccagccagagggggccccaggggaagcaggggcaca

SEQ ID NO: 3612 - DNA, 125 bp, Homo sapiens
ccaacagggagttcaagtcagaaaaggggcgcaacaagttcgtgaccgtgcaggccaccttcgggacccaagtggtggagaaggtggtgctggtcagcctgcagagcgggtacctcttcatccag

SEQ ID NO: 3613 - DNA, 90 bp, Homo sapiens
cccacgacgcgcaaggggatgttccagtcactgttactgtccacgacttcccaggcaaaaaactagtgctgtccagtgagaagactgtgc

SEQ ID NO: 3614 - DNA, 27 bp, Homo sapiens
gctgctcctgctactaacccacctccc

SEQ ID NO: 3615 - DNA, 30 bp, Homo sapiens
gtccctctgaccctgcactgtcccagcacc

SEQ ID NO: 3616 - DNA, 27 bp, Homo sapiens
tgcgcctggcaaggggatgcagtttca

SEQ ID NO: 3617 - DNA, 697 bp, Homo sapiens
gtccgtggattctgctttcagttaaacccctgatcacttcacctccctgagcctcagttaccttatctgaatatcgggatcatgacggataattgtatgtcatctattctaccgacggcagccagaggacgcctgtgagcacctgagtcagggcccatccctgctctgcctacagccctccatggctcccaccttcctatgcgtcaaagcccaagtcctccctgcagtccacaaggccctgcacaccttgccctgtcccttccctgccctcccctcctccctctctccccctcgttcactcttctggagccacacgggccatcctccctgttcctccaacacccaggtgcagtcctgccttggcgccttggcacgggctgtgccctcttctcaagaaaaccctcttcttccaaatatccacacagcttgttctctctcctcctttaagtctttgctcaaatgtcaccaatgtctcaattttacaatgaggtctctctgagtaacctataaagtcgcaaatacccaccctgagcgtcccccctccccgctacacacactcctccttcctgccatgtcctgcaaatgagatttattcatttgataattgcttctcccatcgcctcgccctctattgaacctaaatccctccaggaaggaattgttatgtttgttgagggttttgtcacctgaactcagc

SEQ ID NO: 3618 - DNA, 163 bp, Homo sapiens
ctcccttccagctatgtgtacaataatgaccaatctgtttggctacgccgttgtcttgcctttttgggggttggggtctacacggaggttgtgtttacaatgtagaaacctgttttcgctgtgtgtggcgggggcgcgggcacagggtccgtgtctttgtata

SEQ ID NO: 3619 - DNA, 34 bp, Homo sapiens
atctcagaccaaagggtcgtcctcccccagcatt

SEQ ID NO: 3620 - DNA, 32 bp, Homo sapiens
acaaaacagccagcgggcgggaactgttatga

SEQ ID NO: 3621 - DNA, 58 bp, Homo sapiens
gtgcctttcccccagccagggtccaaagaagcttggctggggcagaaataaaccatat

SEQ ID NO: 3622 - DNA, 93 bp, Homo sapiens
tgaccacccgccggcggaagaaggaaggagaatacaacgtccagcaacagtgcccaggctactaccagtcacacctagacctggaggatctgc

SEQ ID NO: 3623 - DNA, 67 bp, Homo sapiens
ggctgtcatcctcatcggcttggcaggactcctgggagtcatcacatgcctgatctgcggtgtcctg

SEQ ID NO: 3624 - DNA, 28 bp, Homo sapiens
cccaacagaaatgagcccttaactggga

SEQ ID NO: 3625 - DNA, 109 bp, Homo sapiens
ggtggactccctgtgtaacttctcgccactggctcggagagtagacagagttgccatctatgaggaatttctgcggatgacccggaatggtacccagctgcagaacttc

SEQ ID NO: 3626 - DNA, 79 bp, Homo sapiens
ttctacctgaatttcaccatcaccaacctaccatattcccaggacaaagcccagccaggcaccaccaattaccagagga

SEQ ID NO: 3627 - DNA, 37 bp, Homo sapiens
atggagtcatcagtttatcaaccaacaagcagctcca

SEQ ID NO: 3628 - DNA, 123 bp, Homo sapiens
cgtgttggtcactgtcaaggcattgttctcctccaatttggaccccagcctggtggagcaagtctttctagataagaccctgaatgcctcattccattggctgggctccacctaccagttggt

SEQ ID NO: 3629 - DNA, 36 bp, Homo sapiens
aggcagtcaactacatgacacattccgcttctgcct

SEQ ID NO: 3630 - DNA, 76 bp, Homo sapiens
cccagaatttatcaatccggggcgagtaccagataaatttccacattgtcaactggaacctcagtaatccagaccc

SEQ ID NO: 3631 - DNA, 33 bp, Homo sapiens
ctatgtcctggacagggatagcctcttcatcaa

SEQ ID NO: 3632 - DNA, 44 bp, Homo sapiens
cagcatgggccccttctacttgggttgccaactgatctccctca

SEQ ID NO: 3633 - DNA, 105 bp, Homo sapiens
catggggtaccacctgaagaccctcacactcaacttcaccatctccaatctccagtattcaccagatatgggcaagggctcagctacattcaactccaccgaggg

SEQ ID NO: 3634 - DNA, 26 bp, Homo sapiens
gcctcctctgtcagaagccacaacag

SEQ ID NO: 3635 - DNA, 149 bp, Homo sapiens
agacacgggtggacctcctctgcacctacctgcagcccctcagcggcccaggtctgcctatcaagcaggtgttccatgagctgagccagcagacccatggcatcacccggctgggcccctactctctggacaaagacagcctctacctt

SEQ ID NO: 3636 - DNA, 48 bp, Homo sapiens
gagcagcctgggtgcacggtacacaggctgcagggtcatcgcactaag

SEQ ID NO: 3637 - DNA, 81 bp, Homo sapiens
tcacactgaacttcaccatcaacaacctgcgctacatggcggacatgggccaacccggctccctcaagttcaacatcacag

SEQ ID NO: 3638 - DNA, 66 bp, Homo sapiens
agctgacccacagcatcactgagctgggcccctacacactggacagggacagtctctatgtcaatg

SEQ ID NO: 3639 - DNA, 48 bp, Homo sapiens
gcccttgttcaagaacaccagtgttggccctctgtactctggctgcag

SEQ ID NO: 3640 - DNA, 29 bp, Homo sapiens
aacatgtggcctggctccaggaagttcaa

SEQ ID NO: 3641 - DNA, 42 bp, Homo sapiens
tgggagcatctaagactccagcctcgatatttggcccttcag

SEQ ID NO: 3642 - DNA, 30 bp, Homo sapiens
actcatcggagctctgtgtccaccaccagc

SEQ ID NO: 3643 - DNA, 31 bp, Homo sapiens
tatgccctggacaacgacagcctctttgtca

SEQ ID NO: 3644 - DNA, 46 bp, Homo sapiens
tgttcaagagcaccagtgttggccctctgtactctggctgcagact

SEQ ID NO: 3645 - DNA, 29 bp, Homo sapiens
tcaccaacctgcggtatgaggagaacatg

SEQ ID NO: 3646 - DNA, 26 bp, Homo sapiens
acatctgggactccagtttctaaacc

SEQ ID NO: 3647 - DNA, 66 bp, Homo sapiens
agctgacccacagcatcactgagctgggcccctacaccctggacagggacagtctctatgtcaatg

SEQ ID NO: 3648 - DNA, 46 bp, Homo sapiens
tgttcaagaacaccagtgttggccctctgtactctggctgcagact

SEQ ID NO: 3649 - DNA, 97 bp, Homo sapiens
cctggtgctattcacaattaacttcaccatcactaacctgcggtatgaggagaacatgcatcaccctggctctagaaagtttaacaccacggagaga

SEQ ID NO: 3650 - DNA, 30 bp, Homo sapiens
tggcaacctcgagaactccagcctccctgt

SEQ ID NO: 3651 - DNA, 31 bp, Homo sapiens
acccatcagagctctatgacgaccaccagaa

SEQ ID NO: 3652 - DNA, 30 bp, Homo sapiens
agtggatgctgtctgcacccatcgtcctga

SEQ ID NO: 3653 - DNA, 40 bp, Homo sapiens
tgcccttgttcaagaacaccagtgtcagctctctgtactc

SEQ ID NO: 3654 - DNA, 25 bp, Homo sapiens
ttttaccatcactaacctgcagtat

SEQ ID NO: 3655 - DNA, 41 bp, Homo sapiens
ctttcacagtacagccggaaacctctgagactccatcatcc

SEQ ID NO: 3656 - DNA, 31 bp, Homo sapiens
atggagtagccaccagagtggacgccatctg

SEQ ID NO: 3657 - DNA, 28 bp, Homo sapiens
tgttcaagagcaccagtgttggccctct

SEQ ID NO: 3658 - DNA, 25 bp, Homo sapiens
tccttggacttccacagttgacctt

SEQ ID NO: 3659 - DNA, 34 bp, Homo sapiens
caccaccttaaccctcaaagccctggactggaca

SEQ ID NO: 3660 - DNA, 26 bp, Homo sapiens
ggccctctgtactctggctgcagact

SEQ ID NO: 3661 - DNA, 93 bp, Homo sapiens
tctcctggtgccgttcaccctcaactttaccatcaccaatctgcagtatggggaggacatgcgtcaccctggctccaggaagttcaacaccac

SEQ ID NO: 3662 - DNA, 33 bp, Homo sapiens
gggacctccacagtggaccttgggacctcaggg

SEQ ID NO: 3663 - DNA, 25 bp, Homo sapiens
tgacccatggcatcaaagagctggg

SEQ ID NO: 3664 - DNA, 26 bp, Homo sapiens
ggccttctgtactctggctgcagact

SEQ ID NO: 3665 - DNA, 66 bp, Homo sapiens
atcaccaacctgcagtacgaggaggacatgcatcacccaggctccaggaagttcaacaccacggag

SEQ ID NO: 3666 - DNA, 33 bp, Homo sapiens; identical to SEQ ID NO: 3662

SEQ ID NO: 3667 - DNA, 30 bp, Homo sapiens
cccatcagacctctgcgcccaacaccagca

SEQ ID NO: 3668 - DNA, 101 bp, Homo sapiens
tggagtggatgccatctgcacccaccgtcttgaccccaaaagccctggagtggacagggagcagctatactgggagctgagccagctgaccaatggcatca

SEQ ID NO: 3669 - DNA, 46 bp, Homo sapiens; identical to SEQ ID NO: 3648

SEQ ID NO: 3670 - DNA, 93 bp, Homo sapiens
tctcctggtgccgttcaccctcaacttcaccatcaccaacctgaagtacgaggaggacatgcattgccctggctccaggaagttcaacaccac

SEQ ID NO: 3671 - DNA, 40 bp, Homo sapiens
tccacagtggaccttgggtcagggactccatcctccctcc

SEQ ID NO: 3672 - DNA, 143 bp, Homo sapiens
tggagtggatgccatctgcacccaccgtcttgaccccaaaagccctggagtggacagggagcagctatactgggagctgagccagctgaccaatggcatcaaagagctgggcccctacaccctggacaggaacagtctctatg

SEQ ID NO: 3673 - DNA, 26 bp, Homo sapiens
ggccttctgtactctggctgcagact

SEQ ID NO: 3674 - DNA, 26 bp, Homo sapiens
cctggctccaggaagttcaacaccac

SEQ ID NO: 3675 - DNA, 60 bp, Homo sapiens
gggacctccacagtggaccttggaacctcagggactccattctccctcccaagccccgca

SEQ ID NO: 3676 - DNA, 32 bp, Homo sapiens
tttcacccatcggacctctgtgcccaccagca

SEQ ID NO: 3677 - DNA, 55 bp, Homo sapiens
ggcatcaaagagctgggcccctacaccctggacaggaacagtctctatgtcaatg

SEQ ID NO: 3678 - DNA, 30 bp, Homo sapiens
tgttggccctctgtactctggctgcagact

SEQ ID NO: 3679 - DNA, 26 bp, Homo sapiens
cctggctccaggaagttcaacaccac

SEQ ID NO: 3680 - DNA, 42 bp, Homo sapiens
cctccacagtggatctcagaacctcagggactccatcctccc

SEQ ID NO: 3681 - DNA, 27 bp, Homo sapiens
taagcaaactgaccaatgacattgaag

SEQ ID NO: 3682 - DNA, 49 bp, Homo sapiens
gcccttgttcaagaacaccagtgttggccctctgtactctggctgcaga

SEQ ID NO: 3683 - DNA, 29 bp, Homo sapiens
atcaccaacctgcagtacgaggaggacat

SEQ ID NO: 3684 - DNA, 50 bp, Homo sapiens
cctgggacctccacagtggatgtgggaacctcagggactccatcctccag

SEQ ID NO: 3685 - DNA, 32 bp, Homo sapiens
tttcacccatcgaagctctatgcccaccacca

SEQ ID NO: 3686 - DNA, 123 bp, Homo sapiens
gaaggatagctcagccacggcagtggatgccatctgcacacatcgccctgaccctgaagacctcggactggacagagagcgactgtactgggagctgagcaatctgacaaatggcatccagga

SEQ ID NO: 3687 - DNA, 59 bp, Homo sapiens
ccttgttcaggaatagcagtctggaatacctctattcaggctgcagactagcctcactc

SEQ ID NO: 3688 - DNA, 29 bp, Homo sapiens
atcaccaacctgcagtacgaggaggacat

SEQ ID NO: 3689 - DNA, 33 bp, Homo sapiens
ggatttccacatcctccatccccagctccacag

SEQ ID NO: 3690 - DNA, 28 bp, Homo sapiens
cgtcggtactggacccctgccaccagca

SEQ ID NO: 3691 - DNA, 2989 bp, Homo sapiens
tcgcctgctgtatcacggttggtgacctcaatggtcaccagtttggcggcaaagacaagtacaactaatcgagctctgacaaactcccctggtgaaccagctacaacagtttcattggtcacgcatcctgcacagaccagcccaacagttccctggacaacttccatttttttccatagtaaatcagacaccacaccttcaatgaccaccagtcatggggcagaatccagttcagctgttccaactccaactgtttcaactgaggtaccaggagtagtgacccctttggtcaccagttctagggcagtgatcagtacaactattccaattctgactctttctcctggtgaaccagagaccacaccttcaatggccaccagtcatggggaagaagccagttctgctattccaactccaactgtttcacctggggtaccaggagtggtgacctctctggtcactagttctagggcagtgactagtacaactattccaattctgactttttctcttggtgaaccagagaccacaccttcaatggccaccagtcatgggacagaagctggctcagctgttccaactgttttacctgaggtaccaggaatggtgacctctctggttgctagttctagggcagtaaccagtacaactcttccaactctgactctttctcctggtgaaccagagaccacaccttcaatggccaccagtcatggggcagaagccagctcaactgttccaactgtttcacctgaggtaccaggagtggtgacctctctggtcactagttctagtggagtaaacagtacaagtattccaactctgattctttctcctggtgaactagaaaccacaccttcaatggccaccagtcatggggcagaagccagctcagctgttccaactccaactgtttcacctggggtatcaggagtggtgacccctctggtcactagttccagggcagtgaccagtacaactattccaattctaactctttcttctagtgagccagagaccacaccttcaatggccaccagtcatggggtagaagccagctcagctgttctaactgtttcacctgaggtaccaggaatggtgacctctctggtcactagttctagagcagtaaccagtacaactattccaactctgactatttcttctgatgaaccagagaccacaacttcattggtcacccattctgaggcaaagatgatttcagccattccaactttagctgtctcccctactgtacaagggctggtgacttcactggtcactagttctgggtcagagaccagtgcgttttcaaatctaactgttgcctcaagtcaaccagagaccatagactcatgggtcgctcatcctgggacagaagcaagttctgttgttccaactttgactgtctccactggtgagccgtttacaaatatctcattggtcacccatcctgcagagagtagctcaactcttcccaggacaacctcaaggttttcccacagtgaattagacactatgccttctacagtcaccagtcctgaggcagaatccagctcagccatttcaacaactatttcacctggtataccaggtgtgctgacatcactggtcactagctctgggagagacatcagtgcaacttttccaacagtgcctgagtccccacatgaatcagaggcaacagcctcatgggttactcatcctgcagtcaccagcacaacagttcccaggacaacccctaattattctcatagtgaaccagacaccacaccatcaatagccaccagtcctggggcagaagccacttcagattttccaacaataactgtctcacctgatgtaccagatatggtaacctcacaggtcactagttctgggacagacaccagtataactattccaactctgactctttcttctggtgagccagagaccacaacctcatttatcacctattctgagacacacacaagttcagccattccaactctccctgtctcccctggtgcatcaaagatgctgacctcactggtcatcagttctgggacagacagcactacaactttcccaacactgacggagaccccatatgaaccagagacaacagccatacagctcattcatcctgcagagaccaacacaatggttcccaggacaactcccaagttttcccatagtaagtcagacaccacactcccagtagccatcaccagtcctgggccagaagccagttcagctgtttcaacgacaactatctcacctgatatgtcagatctggtgacctcactggtccctagttctgggacagacaccagtacaaccttcccaacattgagtgagaccccatatgaaccagagactacagccacgtggctcactcatcctgcagaaaccagcacaacggtttctgggacaattcccaacttttcccataggggatcagacactgcaccctcaatggtcaccagtcctggagtagacacgaggtcaggtgttccaactacaaccatcccacccagtataccaggggtagtgacctcacaggtcactagttctgcaacagacactagtacagctattccaactttgactccttctcctggtgaaccagagaccacagcctcatcagctacccatcctgggacacagactggcttcactgttccaattcggactgttccctctagtgagccagatacaatggcttcctgggtcactcatcctccacagaccagcacacctgtttccagaacaacctccagtttttcccatagtagtccagatgccacacctgtaatggccaccagtcctaggacagaagccagttcagctgtactgacaacaatctcacctggtgcaccagagatggtgacttcacagatcactagttctggggcagcaaccagtacaactgttccaactttgactcattctcctggtatgccagagaccacagccttattgagcacccatcccagaacagaga

SEQ ID NO: 3692 - DNA, 78 bp, Homo sapiens
aaaatacccaatgaagcagcacacagaggtaccataagaccagtcaaaggccctcagacatccacttcgcctgccagt

SEQ ID NO: 3693 - DNA, 165 bp, Homo sapiens
gcagcactactgaaggacgcttggttatggtcagtactttggacacttcaagccaaccaggcaggacatcttcatcacccattttggataccagaatgacagagagcgttgagctgggaacagtgacaagtgcttatcaagttccttcactctcaacacggttga

SEQ ID NO: 3694 - DNA, 77 bp, Homo sapiens
cctggggatgctactctgtccaccattgcagagagcctgccttcatccactcctgtgccattctcctcttcaacctt

SEQ ID NO: 3695 - DNA, 43 bp, Homo sapiens
tcatttgccaccactggagttccacgagccatctcaggttcag

SEQ ID NO: 3696 - DNA, 383 bp, Homo sapiens
tccaaggctacatacccagtgggtactccctcttccatggctgaaacctctatttccacatcaatgcctgctaattttgagaccacaggatttgaggctgagccattttctcatttgacttctggatttaggaagacaaacatgtccctggacaccagctcagtcacaccaacaaatacaccttcttctcctgggtccactcaccttttacagagttccaagactgatttcacctcttctgcaaaaacatcatccccagactggcctccagcctcacagtatactgaaattccagtggacataatcaccccctttaatgcttctccatctattacggagtccactgggataacctccttcccagaatccaggtttactatgtc

SEQ ID NO: 3697 - DNA, 6746 bp, Homo sapiens
tggcccggcgacaaccacagatatcttgggtacaagcacagaacctggaaccagttcatcttcaagtttgagcaccacctcccatgagagactgaccacttacaaagacactgcacatacagaagccgtgcatccttccacaaacacaggagggaccaatgtggcaaccaccagctctggatataaatcacagtcctctgtcctagctgactcatctccaatgtgtaccacctccaccatgggggatacaagtgttctcacatcaactcctgccttccttgagactaggaggattcagacagagctagcttcctccctgacccctggattgagggagtccagcggctctgaagggaccagctcaggcaccaagatgagcactgtcctctctaaagtgcccactggtgctactactgagatctccaaggaagacgtcacctccatcccaggtcccgctcaatccacaatatcaccagacatctccacaagaaccgtcagctggttctctacatcccctgtcatgacagaatcagcagaaataaccatgaacacccatacaagtcctttaggggccacaacacaaggcaccagtactttggacacgtcaagcacaacctctttgacaatgacacactcaactatatctcaaggattttcacactcacagatgagcactcttatgaggaggggtcctgaggatgtatcatggatgagccctccccttctggaaaaaactagaccttccttttctctgatgtcttcaccagccacaacttcaccttctcctgtttcctccacattaccagagagcatctcttcctctcctcttcctgtgacttcactcctcacgtctggcttggcaaaaactacagatatgttgcacaaaagctcagaacctgtaaccaactcacctgcaaatttgagcagcacctcagttgaaatactggccacctctgaagtcaccacagatacagagaaaactcatccttcttcaaacagaacagtgaccgatgtggggacctccagttctggacatgaatccacttcctttgtcctagctgactcacagacatccaaagtcacatctccaatggttattacctccaccatggaggatacgagtgtctccacatcaactcctggcttttttgagactagcagaattcagacagaaccaacatcctccctgacccttggactgagaaagaccagcagctctgaggggaccagcttagccacagagatgagcactgtcctttctggagtgcccactggtgccactgctgaagtctccaggacagaagtcacctcctctagcagaacatccatctcaggctttgctcagctcacagtgtcaccagagacttccacagaaaccatcaccagactccctacctccagcataatgacagaatcagcagaaatgatgatcaagacacaaacagatcctcctgggtctacaccagagagtactcatactgtggacatatcaacaacacccaactgggtagaaacccactcgactgtgactcagagattttcacactcagagatgaccactcttgtgagcagaagccctggtgatatgttatggcctagtcaatcctctgtggaagaaaccagctctgcctcttccctgctgtctctgcctgccacgacctcaccttctcctgtttcctctacattagtagaggatttcccttccgcttctcttcctgtgacttctcttctcaaccctggcctggtgataaccacagacaggatgggcataagcagagaacctggaaccagttccacttcaaatttgagcagcacctcccatgagagactgaccactttggaagacactgtagatacagaagacatgcagccttccacacacacagcagtgaccaacgtgaggacctccatttctggacatgaatcacaatcttctgtcctatctgactcagagacacccaaagccacatctccaatgggtaccacctacaccatgggggaaacgagtgtttccatatccacttctgacttctttgagaccagcagaattcagatagaaccaacatcctccctgacttctggattgagggagaccagcagctctgagaggatcagctcagccacagagggaagcactgtcctttctgaagtgcccagtggtgctaccactgaggtctccaggacagaagtgatatcctctaggggaacatccatgtcagggcctgatcagttcaccatatcaccagacatctctactgaagcgatcaccaggctttctacttcccccattatgacagaatcagcagaaagtgccatcactattgagacaggttctcctggggctacatcagagggtaccctcaccttggacacctcaacaacaaccttttggtcagggacccactcaactgcatctccaggattttcacactcagagatgaccactcttatgagtagaactcctggagatgtgccatggccgagccttccctctgtggaagaagccagctctgtctcttcctcactgtcttcacctgccatgacctcaacttcttttttctccacattaccagagagcatctcctcctctcctcatcctgtgactgcacttctcacccttggcccagtgaagaccacagacatgttgcgcacaagctcagaacctgaaaccagttcacctccaaatttgagcagcacctcagctgaaatattagccacgtctgaagtcaccaaagatagagagaaaattcatccctcctcaaacacacctgtagtcaatgtagggactgtgatttataaacatctatccccttcctctgttttggctgacttagtgacaacaaaacccacatctccaatggctaccacctccactctggggaatacaagtgtttccacatcaactcctgccttcccagaaactatgatgacacagccaacttcctccctgacttctggattaagggagatcagtacctctcaagagaccagctcagcaacagagagaagtgcttctctttctggaatgcccactggtgctactactaaggtctccagaacagaagccctctccttaggcagaacatccaccccaggtcctgctcaatccacaatatcaccagaaatctccacggaaaccatcactagaatttctactcccctcaccacgacaggatcagcagaaatgaccatcacccccaaaacaggtcattctggggcatcctcacaaggtacctttaccttggacacatcaagcagagcctcctggccaggaactcactcagctgcaactcacagatctccacactcagggatgaccactcctatgagcagaggtcctgaggatgtgtcatggccaagccgcccatcagtggaaaaaactagccctccatcttccctggtgtctttatctgcagtaacctcaccttcgccactttattccacaccatctgagagtagccactcatctcctctccgggtgacttctcttttcacccctgtcatgatgaagaccacagacatgttggacacaagcttggaacctgtgaccacttcacctcccagtatgaatatcacctcagatgagagtctggccacttctaaagccaccatggagacagaggcaattcagctttcagaaaacacagctgtgactcagatgggcaccatcagcgctagacaagaattctattcctcttatccaggcctcccagagccatccaaagtgacatctccagtggtcacctcttccaccataaaagacattgtttctacaaccatacctgcttcctctgagataacaagaattgagatggagtcaacatccaccctgacccccacaccaagggagaccagcacctcccaggagatccactcagccacaaagccaagcactgttccttacaaggcactcactagtgccacgattgaggactccatgacacaagtcatgtcctctagcagaggacctagccctgatcagtccacaatgtcacaagacatatccactgaagtgatcaccaggctctctacctcccccatcaagacagaatctacagaaatgaccattaccacccaaacaggttctcctggggctacatcaaggggtacccttaccttggacacttcaacaacttttatgtcagggacccactcaactgcatctcaaggattttcacactcacagatgaccgctcttatgagtagaactcctggagatgtgccatggctaagccatccctctgtggaagaagccagctctgcctctttctcactgtcttcacctgtcatgacctcatcttctcccgtttcttccacattaccagacagcatccactcttcttcgcttcctgtgacatcacttctcacctcagggctggtgaagaccacagagctgttgggcacaagctcagaacctgaaaccagttcacccccaaatttgagcagcacctcagctgaaatactggccatcactgaagtcactacagatacagagaaactggagatgaccaatgtggtaacctcaggttatacacatgaatctccttcctctgtcctagctgactcagtgacaacaaaggccacatcttcaatgggtatcacctaccccacaggagatacaaatgttctcacatcaacccctgccttctctgacaccagtaggattcaaacaaagtcaaagctctcactgactcctgggttgatggagaccagcatctctgaagagaccagctctgccacagaaaaaagcactgtcctttctagtgtgcccactggtgctactactgaggtctccaggacagaagccatctcttctagcagaacatccatcccaggccctgctcaatccacaatgtcatcagacacctccatggaaaccatcactagaatttctacccccctcacaaggaaagaatcaacagacatggccatcacccccaaaacaggtccttctggggctacctcgcagggtacctttaccttggactcatcaagcacagcctcctggccaggaactcactcagctacaactcagagatttccacagtcagtggtgacaactcctatgagcagaggtcctgaggatgtgtcatggccaagcccgctgtctgtggaaaaaaacagccctccatcttccctggtatcttcatcttcagtaacctcaccttcgccactttattccacaccatctgggagtagccactcctctcctgtccctgtcacttctcttttcacctctatcatgatgaaggccacagacatgttggatgcaagtttggaacctgagaccacttcagctcccaatatgaatatcacctcagatgagagtctggccgcttctaaagccaccacggagacagaggcaattcacgtttttgaaaatacagcagcgtcccatgtggaaaccaccagtgctacagaggaactctattcctcttccccaggcttctcagagccaacaaaagtgatatctccagtggtcacctcttcctctataagagacaacatggtttccacaacaatgcctggctcctctggcattacaaggattgagatagagtcaatgtcatctctgacccctggactgagggagaccagaacctcccaggacatcacctcatccacagagacaagcactgtcctttacaagatgccctctggtgccactcctgaggtctccaggacagaagttatgccctctagcagaacatccattcctggccctgctcagtccacaatgtcactagacatctccgatgaagttgtcaccaggctgtctacctctcccatcatgacagaatctgcagaaataaccatcaccacccaaacaggttattctctggctacatcccaggttacccttcccttgggcacctcaatgacctttttgtcagggacccactcaactatgtctcaaggactttcacactcagagatgaccaatcttatgagcaggggtcctgaaagtctgtcatggacgagccctcgctttgtggaaacaactagatcttcctcttctctgacatcattacctctcacgacctcactttctcctgtgtcctccacattactagacagtagcccctcctctcctcttcctgtgacttcacttatcctcccaggcctggtgaagactacagaagtgttggatacaagctcagagcctaaaaccagttcatctccaaatttgagcagcacctcagttgaaataccggccacctctgaaatcatgacagatacagagaaaattcatccttcctcaaacacagcggtggccaaagtgaggacctccagttctgttcatgaatctcattcctctgtcctagctgactcagaaacaaccataaccataccttcaatgggtatcacctccgctgtggacgataccactgttttcacatcaaatcctgccttctctgagactaggaggattccgacagagccaacattctcattgactcctggattcagggagactagcacctctgaagagaccacctcaatcacagaaacaagtgcagtcctttatggagtgcccactagtgctactactgaagtctccatgacagaaatcatgtcctctaatagaatacacatccctgactctgatcagtccacgatgtctccagacatcatcactgaagtgatcaccaggctctcttcctcatccatgatgtcagaatcaacacaaatgaccatcaccacccaaaaaagttctcctggggctacagcacagagtactctta

SEQ ID NO: 3698 - DNA, 633 bp, Homo sapiens
gggcacatttaccttggacacaccaactacatcctccagggcaggaacacactcgatggcgactcaggaatttccacactcagaaatgaccactgtcatgaacaaggaccctgagattctatcatggacaatccctccttctatagagaaaaccagcttctcctcttccctgatgccttcaccagccatgacttcacctcctgtttcctcaacattaccaaagaccattcacaccactccttctcctatgacctcactgctcacccctagcctagtgatgaccacagacacattgggcacaagcccagaacctacaaccagttcacctccaaatttgagcagtacctcacatgagatactgacaacagatgaagacaccacagctatagaagccatgcatccttccacaagcacagcagcgactaatgtggaaaccaccagttctggacatgggtcacaatcctctgtcctagctgactcagaaaaaaccaaggccacagctccaatggataccacctccaccatggggcatacaactgtttccacatcaatgtctgtttcctctgagactacaaaaattaagagagagtcaacatattccttgactcctggactgagagagaccagcatttc

SEQ ID NO: 3699 - DNA, 7479 bp, Homo sapiens
ctcgtgtccagaggatgagcatctcagttcctgacattttaagtacaagttggactcccagtagtacagaagcagaagatgtgcctgtttcaatggtttctacagatcatgctagtacaaagactgacccaaatacgcccctgtccacttttctgtttgattctctgtccactcttgactgggacactgggagatctctgtcatcagccacagccactacctcagctcctcagggggccacaactccccaggaactcactttggaaaccatgatcagcccagctacctcacagttgcccttctctatagggcacattacaagtgcagtcacaccagctgcaatggcaaggagctctggagttactttttcaagaccagatcccacaagcaaaaaggcagagcagacttccactcagcttcccaccaccacttctgcacatccagggcaggtgcccagatcagcagcaacaactctggatgtgatcccacacacagcaaaaactccagatgcaacttttcagagacaagggcagacagctcttacaacagaggcaagagctacatctgactcctggaatgagaaagaaaaatcaaccccaagtgcaccttggatcactgagatgatgaattctgtctcagaagataccatcaaggaggttaccagctcctccagtgtattaaggaccctgaatacgctggacataaacttggaatctgggacgacttcatccccaagttggaaaagcagcccatatgagagaattgccccttctgagtccaccacagacaaagaggcaattcacccttctacaaacacagtagagaccacaggctgggtcacaagttccgaacatgcttctcattccactatcccagcccactcagcgtcatccaaactcacatctccagtggttacaacctccaccagggaacaagcaatagtttctatgtcaacaaccacatggccagagtctacaagggctagaacagagcctaattccttcttgactattgaactgagggacgtcagcccttacatggacaccagctcaaccacacaaacaagtattatctcttccccaggttccactgcgatcaccaaggggcctagaacagaaattacctcctctaagagaatatccagctcattccttgcccagtctatgaggtcgtcagacagcccctcagaagccatcaccaggctgtctaactttcctgccatgacagaatctggaggaatgatccttgctatgcaaacaagtccacctggcgctacatcactaagtgcacctactttggatacatcagccacagcctcctggacagggactccactggctacgactcagagatttacatactcagagaagaccactctctttagcaaaggtcctgaggatacatcacagccaagccctccctctgtggaagaaaccagctcttcctcttccctggtacctatccatgctacaacctcgccttccaatattttgttgacatcacaagggcacagtccctcctctactccacctgtgacctcagttttcttgtctgagacctctggcctggggaagaccacagacatgtcgaggataagcttggaacctggcacaagtttacctcccaatttgagcagtacagcaggtgaggcgttatccacttatgaagcctccagagatacaaaggcaattcatcattctgcagacacagcagtgacgaatatggaggcaaccagttctgaatattctcctatcccaggccatacaaagccatccaaagccacatctccattggttacctcccacatcatgggggacatcacttcttccacatcagtatttggctcctccgagaccacagagattgagacagtgtcctctgtgaaccagggacttcaggagagaagcacatcccaggtggccagctctgctacagagacaagcactgtcattacccatgtgtctagtggtgatgctactactcatgtcaccaagacacaagccactttctctagcggaacatccatctcaagccctcatcagtttataacttctaccaacacatttacagatgtgagcaccaacccctccacctctctgataatgacagaatcttcaggagtgaccatcaccacccaaacaggtcctactggagctgcaacacagggtccatatctcttggacacatcaaccatgccttacttgacagagactccattagctgtgactccagattttatgcaatcagagaagaccactctcataagcaaaggtcccaaggatgtgtcctggacaagccctccctctgtggcagaaaccagctatccctcttccctgacacctttcttggtcacaaccatacctcctgccacttccacgttacaagggcaacatacatcctctcctgtttctgcgacttcagttcttacctctggactggtgaagaccacagatatgttgaacacaagcatggaacctgtgaccaattcacctcaaaatttgaacaatccatcaaatgagatactggccactttggcagccaccacagatatagagactattcatccttccataaacaaagcagtgaccaatatggggactgccagttcagcacatgtactgcattccactctcccagtcagctcagaaccatctacagccacatctccaatggttcctgcctccagcatgggggacgctcttgcttctatatcaatacctggttctgagaccacagacattgagggagagccaacatcctccctgactgctggacgaaaagagaacagcaccctccaggagatgaactcaactacagagtcaaacatcatcctctccaatgtgtctgtgggggctattactgaagccacaaaaatggaagtcccctcttttgatgcaacattcataccaactcctgctcagtcaacaaagttcccagatattttctcagtagccagcagtagactttcaaactctcctcccatgacaatatctacccacatgaccaccacccagacagggtcttctggagctacatcaaagattccacttgccttagacacatcaaccttggaaacctcagcagggactccatcagtggtgactgaggggtttgcccactcaaaaataaccactgcaatgaacaatgatgtcaaggacgtgtcacagacaaaccctccctttcaggatgaagccagctctccctcttctcaagcacctgtccttgtcacaaccttaccttcttctgttgctttcacaccgcaatggcacagtacctcctctcctgtttctatgtcctcagttcttacttcttcactggtaaagaccgcaggcaaggtggatacaagcttagaaacagtgaccagttcacctcaaagtatgagcaacactttggatgacatatcggtcacttcagcagccaccacagatatagagacaacgcatccttccataaacacagtagttaccaatgtggggaccaccggttcagcatttgaatcacattctactgtctcagcttacccagagccatctaaagtcacatctccaaatgttaccacctccaccatggaagacaccacaatttccagatcaatacctaaatcctctaagactacaagaactgagactgagacaacttcctccctgactcctaaactgagggagaccagcatctcccaggagatcacctcgtccacagagacaagcactgttccttacaaagagctcactggtgccactaccgaggtatccaggacagatgtcacttcctctagcagtacatccttccctggccctgatcagtccacagtgtcactagacatctccacagaaaccaacaccaggctgtctacctccccaataatgacagaatctgcagaaataaccatcaccacccaaacaggtcctcatggggctacatcacaggatacttttaccatggacccatcaaatacaaccccccaggcagggatccactcagctatgactcatggattttcacaattggatgtgaccactcttatgagcagaattccacaggatgtatcatggacaagtcctccctctgtggataaaaccagctccccctcttcctttctgtcctcacctgcaatgaccacaccttccctgatttcttctaccttaccagaggataagctctcctctcctatgacttcacttctcacctctggcctagtgaagattacagacatattacgtacacgcttggaacctgtgaccagctcacttccaaatttcagcagcacctcagataagatactggccacttctaaagacagtaaagacacaaaggaaatttttccttctataaacacagaagagaccaatgtgaaagccaacaactctggacatgaatcccattcccctgcactggctgactcagagacacccaaagccacaactcaaatggttatcaccaccactgtgggagatccagctccttccacatcaatgccagtgcatggttcctctgagactacaaacattaagagagagccaacatatttcttgactcctagactgagagagaccagtacctctcaggagtccagctttcccacggacacaagttttctactttccaaagtccccactggtactattactgaggtctccagtacaggggtcaactcttctagcaaaatttccaccccagaccatgataagtccacagtgccacctgacaccttcacaggagagatccccagggtcttcacctcctctattaagacaaaatctgcagaaatgacgatcaccacccaagcaagtcctcctgagtctgcatcgcacagtacccttcccttggacacatcaaccacactttcccagggagggactcattcaactgtgactcagggattcccatactcagaggtgaccactctcatgggcatgggtcctgggaatgtgtcatggatgacaactccccctgtggaagaaaccagctctgtgtcttccctgatgtcttcacctgccatgacatccccttctcctgtttcctccacatcaccacagagcatcccctcctctcctcttcctgtgactgcacttcctacttctgttctggtgacaaccacagatgtgttgggcacaacaagcccagagtctgtaaccagttcacctccaaatttgagcagcatcactcatgagagaccggccacttacaaagacactgcacacacagaagccgccatgcatcattccacaaacaccgcagtgaccaatgtagggacttccgggtctggacataaatcacaatcctctgtcctagctgactcagagacatcgaaagccacacctctgatgagtaccacctccaccctgggggacacaagtgtttccacatcaactcctaatatctctcagactaaccaaattcaaacagagccaacagcatccctgagccctagactgagggagagcagcacgtctgagaagaccagctcaacaacagagacaaatactgccttttcttatgtgcccacaggtgctattactcaggcctccagaacagaaatctcctctagcagaacatccatctcagaccttgatcggcccacaatagcacccgacatctccacaggaatgatcaccaggctcttcacctcccccatcatgacaaaatctgcagaaatgaccgtcaccactcaaacaactactcctggggctacatcacagggtatccttccctgggacacatcaaccacacttttccagggagggactcattcaaccgtgtctcagggattcccacactcagagataaccactcttcggagcagaacccctggagatgtgtcatggatgacaactccccctgtggaagaaaccagctctgggttttccctgatgtcaccttccatgacatccccttctcctgtttcctccacatcaccagagagcatcccctcctctcctctccctgtgactgcacttcttacttctgttctggtgacaaccacaaatgtattgggcacaacaagcccagagcccgtaacgagttcacctccaaatttaagcagccccacacaggagagactgaccacttacaaagacactgcgcacacagaagccatgcatgcttccatgcatacaaacactgcagtggccaacgtggggacctccatttctggacatgaatcacaatcttctgtcccagctgattcacacacatccaaagccacatctccaatgggtatcaccttcgccatgggggatacaagtgtttctacatcaactcctgccttctttgagactagaattcagactgaatcaacatcctctttgattcctggattaagggacaccaggacgtctgaggagatcaacactgtgacagagaccagcactgtcctttcagaagtgcccactactactactactgaggtctccaggacagaagttatcacttccagcagaacaaccatctcagggcctgatcattccaaaatgtcaccctacatctccacagaaaccatcaccaggctctccacttttccttttgtaacaggatccacagaaatggccatcaccaaccaaacaggtcctatagggactatctcacaggctacccttaccctggacacatcaagcacagcttcctgggaagggactcactcacctgtgactcagagatttccacactcagaggagaccactactatgagcagaagtactaagggcgtgtcatggcaaagccctccctctgtggaagaaaccagttctccttcttccccagtgcctttacctgcaataacctcacattcatctctttattccgcagtatcaggaagtagccccacttctgctctccctgtgacttcccttctcacctctggcaggaggaagaccatagacatgttggacacacactcagaacttgtgaccagctccttaccaagtgcaagtagcttctcaggtgagatactcacttctgaagcctccacaaatacagagacaattcacttttcagagaacacagcagaaaccaatatggggaccaccaattctatgcataaactacattcctctgtctcaatccactcccagccatccggacacacacctccaaaggttactggatctatgatggaggacgctattgtttccacatcaacacctggttctcctgagactaaaaatgttgacagagactcaacatcccctctgactcctgaactgaaagaggacagcaccgccctggtgatgaactcaactacagagtcaaacactgttttctccagtgtgtccctggatgctgctactgaggtctccagggcagaagtcacctactatgatcctacattcatgccagcttctgctcagtcaacaaagtccccagacatttcacctgaagccagcagcagtcattctaactctcctcccttgacaatatctacacacaagaccatcgccacacaaacaggtccttctggggtgacatctcttggccaactga

SEQ ID NO: 3700 - DNA, 37 bp, Homo sapiens
gttctccagaaacatgggcaagctctatttcagttcc

SEQ ID NO: 3701 - DNA, 235 bp, Homo sapiens
gcaaggtctggttctagttcctctcccataagcctatccactgagaaagaaacaagcttcctttcccccactgcatccacctccagaaagacttcactatttcttgggccttccatggcaaggcagcccaacatattggtgcatcttcagacttcagctctgacactttctccaacatccactctaaatatgtcccaggaggagcctcctgagttaacctcaagccagaccattg

SEQ ID NO: 3702 - DNA, 94 bp, Homo sapiens
aacaggggaccctagatatgcctcagagagcatgtcttatccagacccaagcaaggcatcatcagctatgacatcgacctctcttgcatcaaaa

SEQ ID NO: 3703 - DNA, 345 bp, Homo sapiens
tactcaatcaacagcacccaaagggatacctgtgaagcccaccagtgctgagtcaggcctcctaacacctgtctctgcctcctcaagcccatcaaaggcctttgcctcactgactacagctcccccaacttgggggatcccacagtctaccttgacatttgagttttctgaggtcccaagtttggatactaagtccgcttctttaccaactcctggacagtccctgaacaccattccagactcagatgcaagcacagcatcttcctcactgtccaagtctccagaaaaaaacccaagggcaaggatgatgacttccacaaaggccataagtgcaagctcatttca

SEQ ID NO: 3704 - DNA, 7840 bp, Homo sapiens
ttggccagtcctacatcttcggttgtgggaagaaccacccagtctttgggggtgatgtcctctgctctccctgagtcaacctctagaggaatgacacactccgagcaaagaaccagcccatcgctgagtccccaggtcaatggaactccctctaggaactaccctgctacaagcatggtttcaggattgagttccccaaggaccaggaccagttccacagaaggaaattttaccaaagaagcatctacatacacactcactgtagagaccacaagtggcccagtcactgagaagtacacagtccccactgagacctcaacaactgaaggtgacagcacagagaccccctgggacacaagatatattcctgtaaaaatcacatctccaatgaaaacatttgcagattcaactgcatccaaggaaaatgccccagtgtctatgactccagctgagaccacagttactgactcacatactccaggaaggacaaacccatcatttgggacactttattcttccttccttgacctatcacctaaagggaccccaaattccagaggtgaaacaagcctggaactgattctatcaaccactggatatcccttctcctctcctgaacctggctctgcaggacacagcagaataagtaccagtgcgcctttgtcatcatctgcttcagttctcgataataaaatatcagagaccagcatattctcaggccagagtctcacctcccctctgtctcctggggtgcccgaggccagagccagcacaatgcccaactcagctatccctttttccatgacactaagcaatgcagaaacaagtgccgaaagggtcagaagcacaatttcctctctggggactccatcaatatccacaaagcagacagcagagactatccttaccttccatgccttcgctgagaccatggatatacccagcacccacatagccaagactttggcttcagaatggttgggaagtccaggtacccttggtggcaccagcacttcagcgctgacaaccacatctccatctaccactttagtctcagaggagaccaacacccatcactccacgagtggaaaggaaacagaaggaactttgaatacatctatgactccacttgagacctctgctcctggagaagagtccgaaatgactgccaccttggtccccactctaggttttacaactcttgacagcaagatcagaagtccatctcaggtctcttcatcccacccaacaagagagctcagaaccacaggcagcacctctgggaggcagagttccagcacagctgcccacgggagctctgacatcctgagggcaaccacttccagcacctcaaaagcatcatcatggaccagtgaaagcacagctcagcaatttagtgaaccccagcacacacagtgggtggagacaagtcctagcatgaaaacagagagacccccagcatcaaccagtgtggcagcccctatcaccacttctgttccctcagtggtctctggcttcaccaccctgaagaccagctccacaaaagggatttggcttgaagaaacatctgcagacacactcatcggagaatccacagctggcccaaccacccatcagtttgctgttcccactgggatttcaatgacaggaggcagcagcaccaggggaagccagggcacaacccacctactcaccagagccacagcatcatctgagacatccgcagatttgactctggccacgaacggtgtcccagtctccgtgtctccagcagtgagcaagacggctgctggctcaagtcctccaggagggacaaagccatcatatacaatggtttcttctgtcatccctgagacatcatctctacagtcctcagctttcagggaaggaaccagcctgggactgactccattaaacactagacatcccttctcttcccctgaaccagactctgcaggacacaccaagataagcaccagcattcctctgttgtcatctgcttcagttcttgaggataaagtgtcagcgaccagcacattctcacaccacaaagccacctcatctattaccacagggactcctgaaatctcaacaaagacaaagcccagctcagccgttctttcctccatgaccctaagcaatgcagcaacaagtcctgaaagagtcagaaatgcaacttcccctctgactcatccatctccatcaggggaagagacagcagggagtgtcctcactctcagcacctctgctgagactacagactcacctaacatccacccaactgggacactgacttcagaatcgtcagagagtcctagcactctcagcctcccaagtgtctctggagtcaaaaccacattttcttcatctactccttccactcatctatttactagtggagaagaaacagaggaaacttcgaatccatctgtgtctcaacctgagacttctgtttccagagtaaggaccaccttggccagcacctctgtccctaccccagtattccccaccatggacacctggcctacacgttcagctcagttctcttcatcccacctagtgagtgagctcagagctacgagcagtacctcagttacaaactcaactggttcagctcttcctaaaatatctcacctcactgggacggcaacaatgtcacagaccaatagagacacgtttaatgactctgctgcaccccaaagcacaacttggccagagactagtcccagattcaagacagggttaccttcagcaacaaccactgtttcaacctctgccacttctctctctgctactgtaatggtctctaaattcacttctccagcaactagttccatggaagcaacttctatcagggaaccatcaacaaccatcctcacaacagagaccacgaatggcccaggctctatggctgtggcttctaccaacatcccaattggaaagggctacattactgaaggaagattggacacaagccatctgcccattggaaccacagcttcctctgagacatctatggattttaccatggccaaagaaagtgtctcaatgtcagtatctccatctcagtccatggatgctgctggctcaagcactccaggaaggacaagccaattcgttgacacattttctgatgatgtctatcatttaacatccagagaaattacaatacctagagatggaacaagctcagctctgactccacaaatgactgcaactcaccctccatctcctgatcctggctctgctagaagcacctggcttggcatcttgtcctcatctccttcttctcctactcccaaagtcacaatgagctccacattttcaactcagagagtcaccacaagcatgataatggacacagttgaaactagtcggtggaacatgcccaacttaccttccacgacttccttgacaccaagtaatattccaacaagtggtgccataggaaaaagcaccctggttcccttggacactccatctccagccacatcattggaggcatcagaagggggacttccaaccctcagcacctaccctgaatcaacaaacacacccagcatccacctcggagcacacgctagttcagaaagtccaagcaccatcaaacttaccatggcttcagtagtaaaacctggctcttacacacctctcaccttcccctcaatagagacccacattcatgtatcaacagccagaatggcttactcttctgggtcttcacctgagatgacagctcctggagagactaacactggtagtacctgggaccccaccacctacatcaccactacggatcctaaggatacaagttcagctcaggtctctacaccccactcagtgaggacactcagaaccacagaaaaccatccaaagacagagtccgccaccccagctgcttactctggaagtcctaaaatctcaagttcacccaatctcaccagtccggccacaaaagcatggaccatcacagacacaactgaacactccactcaattacattacacaaaattggcagaaaaatcatctggatttgagacacagtcagctccaggacctgtctctgtagtaatccctacctcccctaccattggaagcagcacattggaactaacttctgatgtcccaggggaacccctggtccttgctcccagtgagcagaccacaatcactctccccatggcaacatggctgagtaccagtttgacagaggaaatggcttcaacagaccttgatatttcaagtccaagttcacccatgagtacatttgctatttttccacctatgtccacaccttctcatgaactttcaaagtcagaggcagataccagtgccattagaaatacagattcaacaacgttggatcagcacctaggaatcaggagtttgggcagaactggggacttaacaactgttcctatcaccccactgacaaccacgtggaccagtgtgattgaacactcaacacaagcacaggacaccctttctgcaacgatgagtcctactcacgtgacacagtcactcaaagatcaaacatctataccagcctcagcatccccttcccatcttactgaagtctaccctgagctcgggacacaagggagaagctcctctgaggcaaccactttttggaaaccatctacagacacactgtccagagagattgagactggcccaacaaacattcaatccactccacccatggacaacacaacaacagggagcagtagtagtggagtcaccctgggcatagcccaccttcccataggaacatcctccccagctgagacatccacaaacatggcactggaaagaagaagttctacagccactgtctctatggctgggacaatgggactccttgttactagtgctccaggaagaagcatcagccagtcattaggaagagtttcctctgtcctttctgagtcaactactgaaggagtcacagattctagtaagggaagcagcccaaggctgaacacacagggaaatacagctctctcctcctctcttgaacccagctatgctgaaggaagccagatgagcacaagcatccctctaacctcatctcctacaactcctgatgtggaattcatagggggcagcacattttggaccaaggaggtcaccacagttatgacctcagacatctccaagtcttcagcaaggacagagtccagctcagctacccttatgtccacagctttgggaagcactgaaaatacaggaaaagaaaaactcagaactgcctctatggatcttccatctccaactccatcaatggaggtgacaccatggatttctctcactctcagtaatgcccccaataccacagattcacttgacctcagccatggggtgcacaccagctctgcagggactttggccactgacaggtcattgaatactggtgtcactagagcctccagattggaaaacggctctgatacctcttctaagtccctgtctatgggaaacagcactcacacttccatgacttacacagagaagagtgaagtgtcttcttcaatccatccccgacctgagacctcagctcctggagcagagaccactttgacttccactcctggaaacagggccataagcttaacattgcctttttcatccattccagtggaagaagtcatttctacaggcataacctcaggaccagacatcaactcagcacccatgacacattctcccatcaccccaccaacaattgtatggaccagtacaggcacaattgaacagtccactcaaccactacatgcagtttcttcagaaaaagtttctgtgcagacacagtcaactccatatgtcaactctgtggcagtgtctgcttcccctacccatgagaattcagtctcttctggaagcagcacatcctctccatattcctcagcctcacttgaatccttggattccacaatcagtaggaggaatgcaatcacttcctggctatgggacctcactacatctctccccactacaacttggccaagtactagtttatctgaggcactgtcctcaggccattctggggtttcaaacccaagttcaactacgactgaatttccactcttttcagctgcatccacatctgctgctaagcaaagaaatccagaaacagagacccatggtccccagaatacagccgcgagtactttgaacactgatgcatcctcggtcacaggtctttctgagactcctgtgggggcaagtatcagctctgaagtccctcttccaatggccataacttctagatcagatgtttctggccttacatctgagagtactgctaacccgagtttaggcacagcctcttcagcagggaccaaattaactaggacaatatccctgcccacttcagagtctttggtttcctttagaatgaacaaggatccatggacagtgtcaatccctttggggtcccatccaactactaatacagaaacaagcatcccagtaaacagcgcaggtccacctggcttgtccacagtagcatcagatgtaattgacacaccttcagatggggctgagagtattcccactgtctccttttccccctcccctgatactgaagtgacaactatctcacatttcccagaaaagacaactcattcatttagaaccatttcatctctcactcatgagttgacttcaagagtgacacctattcctggggattggatgagttcagctatgtctacaaagcccacaggagccagtccctccattacactgggagagagaaggacaatcacctctgctgctccaaccacttcccccatagttctcactgctagtttcacagagaccagcacagtttcactggataatgaaactacagtaaaaacctcagatatccttgacgcacggaaaacaaatgagctcccctcagatagcagttcttcttctgatctgatcaacacctccatagcttcttcaactatggatgtcactaaaacagcctccatcagtcccactagcatctcaggaatgacagcaagttcctccccatctctcttctcttcagatagaccccaggttcccacatctacaacagagacaaatacagccacctctccatctgtttccagtaacacctattctcttgatgggggctccaatgtgggtggcactccatccactttaccaccctttacaatcacccaccctgtcgagacaagctcggccctattagcctggtctagaccagtaagaactttcagcaccatggtcagcactgacactgcctccggagaaaatcctacctctagcaattctgtggtgacttctgttccagcaccaggtacatggaccagtgtaggcagtactactgacttacctgccatgggctttctcaagacaagtcctgcaggagaggcacactcacttctagcatcaactattgaaccagccactgccttcactccccatctctcagcagcagtggtcactggatccagtgctacatcagaagccagtcttctcactacgagtgaaagcaaagccattcattcttcaccacagaccccaactacacccacctctggagcaaactgggaaacttcagctactcctgagagccttttggtagtcactgagacttcagacacaacacttacctcaaagattttggtcacagataccatcttgttttcaactgtgtccacgccaccttctaaatttccaagtacggggactctgtctggagcttccttccctactttactcccggacactccagccatccctctcactgccactgagccaacaagttcattagctacatcctttgattccaccccactggtgactatagcttcggata

SEQ ID NO: 3705 - DNA, 97 bp, Homo sapiens
gcaggagcactaaagccacaccagaaatggattcaggactgacaggagccaccttgtcacctaagacatctacaggtgcaatcgtggtgacagaaca

SEQ ID NO: 3706 - DNA, 25 bp, Homo sapiens
cctgggtcatcttctcccacccgct

SEQ ID NO: 3707 - DNA, 90 bp, Homo sapiens
ttggcttttctaccccaattcaagaagtcacttcttcagtcaaccaaaccaattacaaaattgtgttccaatgtcacatgttcaaaaata

SEQ ID NO: 3708 - DNA, 156 bp, Homo sapiens
ggttgatgggcccagagatatatcacattgccccttgtggacagggaccaggcaggggactcacatcacaatagaggtaggacaaggaatacatcacaatacgttttgagagcagaaccaaaaaagagtaacataatctttgtgttgagtgcagca

SEQ ID NO: 3709 - DNA, 72 bp, Homo sapiens
gagagaagggtcatatcacctaagctctggattcgcagataggccccaatctcttttttgggcaatgctcgg

SEQ ID NO: 3710 - DNA, 855 bp, Homo sapiens
caccctagtgggcaggtccattaaagagaaggctgtcaaagcacatagatgctgggcaaagtgatatgtcataatccccatgatgataggcccagagacatgtcacaatgacctctttaggcagagaccaggcagaagaatcacatcacttgtgtgctggccctagtgataagtcactctcatttctgtggacatggcccaggcagaagagcagagtcacattacctaagcgctgggtcaagagatatgtcacaatcttttacatgggcaaaacccaggtaaaaaagaggagtaatatcagatagtaggtgttgccagagatatgtcaaaatgccccctgtatgaaagactcaggcagtcaaaacacattagttggtttcttaacctagtgatatgttataatctttcctgtgggtatgatgcaggcagaagacgagagtcatgtgatggatgcagagacatgtcacaaggtcttctgtgggcagggtccagactgaagccttccacctgctaggggttgagcccaatgatatgtcacaatacccaaattatgcagggcccaggcaaaaaaaacgagaggcacatcacctgggttctggatccaatgatatatcacaattttctattttggcaagacccaggcagaaagaaaagttacatcacctaggtgatgaatgaaaatacatattataatagttttgtgggcaggacccatgcgggagagtcacatcacctaggtgttggacccagaaatatgtcacaatatacagtgtatacagagctgaggcatgagacaatagtaacttcactcatttgttgagcccagctatacaatccttttttgggcacagccga

SEQ ID NO: 3711 - DNA, 117 bp, Homo sapiens
attattctcctttgggcagtgcttctgcagaaaagttgcaccttctaggtgttggactcagcaatatatcacaatgtctgcagtattttggaaggagaggagagtcaccattactta

SEQ ID NO: 3712 - DNA, 403 bp, Homo sapiens
gcccagtctagtggtaattagtttccccagcatttatttgtcagggtaagactttatattcttcatttgtgaaggttattctagcttgatataaaatttttggctggcagttttcttttttttcaacactctaaaagtgccatcccattctcttctggtcagtaaagtttctgctgagaagtctgcttttaatctaatgtggttttctttataaattactagatgcttttcttttgcttattttagaattacttccttcactttgactttagatattctgattatcatgtgccattatgatgtctgttttgcaatatattttgtttatattttgttgtattttgtttgctgagcttcctgtgtatgtatgtctaattctattgctagagttggaaagttttca

SEQ ID NO: 3713 - DNA, 26 bp, Homo sapiens
accgcacccaaccaaatctatacatt

SEQ ID NO: 3714 - DNA, 27 bp, Homo sapiens
gcgcgatctcgtcccactgctcactgc

SEQ ID NO: 3715 - DNA, 239 bp, Homo sapiens
taatggactgacatctctagtgattttttttgccagtgagttttaattgccattaagttaaagaatattgttcccataggctaaatttttatttttattttctcatttaaatgtatttgacttaatttttgtggatacctaatatgtgtacatattatgccatatgtggcatattttgatacggacacacaatatataacaatcgcattagactaaatgcggtctccattacctctagc

SEQ ID NO: 3716 - DNA, 161 bp, Homo sapiens
gctttgaactaatgctcacaccttaatgcataggaaagcatttatgcttgagaaaaagtgaacaaatatagacaaaaagccattaatacctgctcacatcgtactcaaattcagagcgttcatactaaataagaagtgtaattactgtcaaacgactgatc

SEQ ID NO: 3717 - DNA, 32 bp, Homo sapiens
gatgtgccaacgcttttgacaagtcaaacttt

SEQ ID NO: 3718 - DNA, 48 bp, Homo sapiens
gtgtgaataatgtggtaaagtctataaaaagtcctgaattcttaacag

SEQ ID NO: 3719 - DNA, 77 bp, Homo sapiens
gcaaatcctttttctggtcctcagccctaaccagacataagaaaattcatactggacagcaaccctacaaacaggaa

SEQ ID NO: 3720 - DNA, 26 bp, Homo sapiens
agaaaattcatactatcacacctgta

SEQ ID NO: 3721 - DNA, 30 bp, Homo sapiens
gtcctcagctcttactaaacataagataat

SEQ ID NO: 3722 - DNA, 25 bp, Homo sapiens
tttatatcatcctcaaccctaaatg

SEQ ID NO: 3723 - DNA, 301 bp, Homo sapiens
catttagccagccttcacaccttactacacataagaggatgcacactggagagaaaccctacaaatgtgaagaatgtggcaaagcttttagccaatcctcaacccttactacacataagataattcatactggagagaaaccctacaaatgtgaagaatgtggcaaagcttttaggaaatcttcaactcttactgaacataagataattcatactggagagaaaccctacaaatgtgaagaatgtggcaaagcatttagccaatcctcaaccctaactagacatacgaggatgcacactgg

SEQ ID NO: 3724 - DNA, 29 bp, Homo sapiens
agagaaaacctacaaatgtgaagaatgtg

SEQ ID NO: 3725 - DNA, 97 bp, Homo sapiens
atcaatcttcaaatcttacgacacataagataattcatactaaagagaaaccttccaagagtgaagaatgtgacaaagcatttatctggtcctcaac

SEQ ID NO: 3726 - DNA, 25 bp, Homo sapiens
ggcaaagcttttaagcactcctcag

SEQ ID NO: 3727 - DNA, 49 bp, Homo sapiens
ggcaaagcttttagccgttcctcaacccttactaagcataagacaattc

SEQ ID NO: 3728 - DNA, 25 bp, Homo sapiens
aactagacataagaggatacacact

SEQ ID NO: 3729 - DNA, 26 bp, Homo sapiens
tgacaaaacttttaagcgactctcaa

SEQ ID NO: 3730 - DNA, 25 bp, Homo sapiens
aactagacataagaggatacacact

SEQ ID NO: 3731 - DNA, 189 bp, Homo sapiens
tttagccgttcttcaacccttgctaaacataagagaattcatactggagagaaaccctacaaatgtaaagaatgtggcaaagcttttagcaattcctcaacccttgctaatcataagataactcatactgaagagaaaccctacaaatgtaaagaatgtgacaaagcttttaagcgactctcaaccctt

SEQ ID NO: 3732 - DNA, 25 bp, Homo sapiens
aactagacataagaggatacacact

SEQ ID NO: 3733 - DNA, 27 bp, Homo sapiens
acccaacataaatgcgtttatattaca

SEQ ID NO: 3734 - DNA, 114 bp, Homo sapiens
gtgggaaatatttgaaagtcttctataaatttttaaattcaaacagacatacgataagacatactggaaagaaatgcttcaaatgtaaaaaatgtgtcaagtcattttgcatcc

SEQ ID NO: 3735 - DNA, 139 bp, Homo sapiens
ttcaaaaagtattactgagaaaatatgaaaaatgtggacatgagaatttacagttaagaaaaggttgtaaaagtgtggatgagtgtaaggtgcacaaagaaggttataataaacttaaccagtgtctcacaactgccca

SEQ ID NO: 3736 - DNA, 72 bp, Homo sapiens
cctgattacttatctggagcaaggaaaagagccctggaatatgaagcaacatgagatggtggatgaacccac

SEQ ID NO: 3737 - DNA, 40 bp, Homo sapiens
tctccggaggagtggcaatgtctggacactgcacagcaga

SEQ ID NO: 3738 - DNA, 31 bp, Homo sapiens
ccggagtttccaggtctcgacttcactgctc

SEQ ID NO: 3739 - DNA, 139 bp, Homo sapiens
tgtttccttcaaatggggtctgccaattcacaaccagatgacccattttaccctattcactgcagactgaatccagattctacacatacttatccccaccaagaccctcactctgtctccattggcctacttgttcatc

SEQ ID NO: 3740 - DNA, 235 bp, Homo sapiens
gagcgcccactcttccaattaaacattctcagccaagaagacagtgagcacacctaccagacactcttcttctcccacctcactctcccactgtacccacccctaaatcattccagtgctctcaaaaagcatgtttttcaagatcattttgtttgttgctctctctagtgtcttcttctctcgtcagtcttagcctgtgccctccccttacccaggcttaggcttaattacctga

SEQ ID NO: 3741 - DNA, 67 bp, Homo sapiens
agccaaacaagcattccagagcctgccagcaatttctcaaacaatgtcagctaagaagctttgctct

SEQ ID NO: 3742 - DNA, 73 bp, Homo sapiens
attggttcctgagagccccgagaagaaaattcatgacagtgtctgggctgccaaagaagcagtgcccctgtga

SEQ ID NO: 3743 - DNA, 57 bp, Homo sapiens
gccacagggaccgaggccaggcttctaggagatggctccaggaaggcggccaagaat

SEQ ID NO: 3744 - DNA, 36 bp, Homo sapiens
cctgttgctgccactaatgctgatgtccatggtctc

SEQ ID NO: 3745 - DNA, 148 bp, Homo sapiens
ccctcaaatgggaacgctggcctgggactaaagcatagaccaccaggctgagtatcctgacctgagtcatccccagggatcaggagcctccagcagggaaccttccattatattcttcaagcaacttacagctgcaccgacagttgcg

SEQ ID NO: 3746 - DNA, 226 bp, Homo sapiens
tcctcccggagtttggaacggctgaagttcaccttccagcccctagcgccgttcgcgccgctaggcctggcttctgaggcggttgcggtgctcggtcgccgcctaggcggggcagggtgcgagcaggggcttcgggccacgcttctcttggcgacaggattttgctgtgaagtccgtccgggaaacggaggaaaaaaagagttgcgggaggctgtcggctaataac

SEQ ID NO: 3747 - DNA, 98 bp, Homo sapiens
tgatacatatttgccagacttcaagatttcagaaaaggggtgaaagagaagattgcaactttgagtcagacctgtaggcctgatagactgattaaacc

SEQ ID NO: 3748 - DNA, 55 bp, Homo sapiens
aaggtgacctgctgagaaaagtggtacaaatactgggaaaaacctgctcttctgc

SEQ ID NO: 3749 - DNA, 93 bp, Homo sapiens
cacaagttaaaagctcttattcctatgatgccccctcggatttcatcaatttttcatccttggatgatgaaggagatactcaaaacatagatt

SEQ ID NO: 3750 - DNA, 79 bp, Homo sapiens
ggaactggagggctttttcagggcaaaactcctttgagaaaggctaatcttcagcaagctattgtcacacctttgaaac

SEQ ID NO: 3751 - DNA, 105 bp, Homo sapiens
gacaacacttactacaaagaggcagaaaaagaaaatcttgtggaacaatccattccgtcaaatgcttgttcttccctggaagttgaggcagccatatcaagaaaa

SEQ ID NO: 3752 - DNA, 36 bp, Homo sapiens
caagagatgtgccactcctgtaatcatcgatgaaat

SEQ ID NO: 3753 - DNA, 92 bp, Homo sapiens
agaaggcagtgctcatcaagatactgctgaaaagaatgcatcttccccagagaaagccaagggtagacatactgtgccttgtatgccacctg

SEQ ID NO: 3754 - DNA, 31 bp, Homo sapiens
gagaagagtatgaaaatgcagcaagaggtgg

SEQ ID NO: 3755 - DNA, 129 bp, Homo sapiens
atcagtgagccaggtcaccaaatcagttgacttccacttccgcacagatgagcgaatcaaacaacatcctaagaaccaggaggaatataaggaagtgaactttacatctgaactacgaaagcatccttc

SEQ ID NO: 3756 - DNA, 121 bp, Homo sapiens
gcccgagtgactaagggatgtaccattgttaagcctttcaacctgtcccaaggaaagaaaagaacatttgatgaaacagtttctacatatgtgccccttgcacagcaagttgaagacttcc

SEQ ID NO: 3757 - DNA, 31 bp, Homo sapiens
atggctcacttcagtgtccaactcctgggct

SEQ ID NO: 3758 - DNA, 183 bp, Homo sapiens
cttgatcccagaatacttgaaggtgggcccatcttgcccaagaaaccacctgtgaaaccacccaccgagcctattggctttgatttggaaattgagaaaagaatccaggagcgagaatcaaagaagaaaacagaggatgaacactttgaatttcattccagaccttgccctactaagattttg

SEQ ID NO: 3759 - DNA, 31 bp, Homo sapiens
tgttcctgaaaagaaggtacttccaatcacc

SEQ ID NO: 3760 - DNA, 34 bp, Homo sapiens
cattgaagaacagaattcgaatgcccaccaaaga

SEQ ID NO: 3761 - DNA, 132 bp, Homo sapiens
gacgaaccggtagtgataaaagctcaacctgtgccacattatggggtgccttttaagccccaaatcccagaggcaagaactgtggaaatatgccctttctcgtttgattctcgagacaaagaacgtcagtta

SEQ ID NO: 3762 - DNA, 110 bp, Homo sapiens
gtgcccaagttcaaggcacttcccttgcctcattttgacaccattaacctgccagagaagaaggtaaagaatgtgacccagattgaacctttctgcttggagactgacag

SEQ ID NO: 3763 - DNA, 41 bp, Homo sapiens
cttgtttcaaggctcgtccaaacaccgtcatctctcaggag

SEQ ID NO: 3764 - DNA, 128 bp, Homo sapiens
ttcaggaaccttttcagctggctactgagaagagagccaaagagcggcaggagctggagaagagaatggctgaggtagaagcccagaaagcccagcagttggaggaggccagactacaggaggaagag

SEQ ID NO: 3765 - DNA, 72 bp, Homo sapiens
gtgcataaggcaaatccaatacgcaagtaccagggtctggagataaagtcaagtgaccagcctctgactgtg

SEQ ID NO: 3766 - DNA, 29 bp, Homo sapiens
ccaaattctccactcgattccactgctaa

SEQ ID NO: 3767 - DNA, 130 bp, Homo sapiens
tcagctgtgagctgcggataccgcccggcaatgggacctgctcttaacctcaaacctaggaccgtcttgctttgtcattgggcatggagagaacccatttctccagacttttacctacccgtgcctgaga

SEQ ID NO: 3768 - DNA, 25 bp, Homo sapiens
cagaaaataaagatagttaaatcct

SEQ ID NO: 3769 - DNA, 170 bp, Homo sapiens
gtcctcttctctgcataccgtgaatttatagttaaggatccctttgctgtgagggtagaaaacctcaccaactgcaccagtgaggaagaagactgcgtggattcatggggagcctcacagcagccacgcagcaggctctgggtggggctgccgttaaggcacgttctttc

SEQ ID NO: 3770 - DNA, 28 bp, Homo sapiens
ggaaccgtgcagtgtgcattttaagacc

SEQ ID NO: 3771 - DNA, 25 bp, Homo sapiens
tggcctggaataaatacgttttgtc

SEQ ID NO: 3772 - DNA, 26 bp, Homo sapiens
ggaagccccacccaccagaagccaag

SEQ ID NO: 3773 - DNA, 149 bp, Homo sapiens
gaccaccaagaagcggccacagcgggccacatccaatgtcttcgcaatgtttgaccagtcccagatccaggagtttaaggaggctttcaacatgattgaccagaaccgtgatggcttcattgacaaggaggacctgcacgacatgctgg

SEQ ID NO: 3774 - DNA, 158 bp, Homo sapiens
agaaccccacagacgaatacctggagggcatgatgagcgaggccccggggcccatcaacttcaccatgttcctcaccatgtttggggagaagctgaacggcacggaccccgaggatgtgattcgcaacgcctttgcctgcttcgacgaggaagcctca

SEQ ID NO: 3775 - DNA, 110 bp, Homo sapiens
aggaagtggacgagatgtaccgggaggcacccattgataagaaaggcaacttcaactacgtggagttcacccgcatcctcaaacatggcgccaaggataaagacgactag

SEQ ID NO: 3776 - DNA, 450 bp, Homo sapiens
cacccgtccataccagctccctgcccatgaccctcgctcagggatccccctttgaggggttagggtcccagttcccagtggaagaaacaggccaggagaagtgcgtgccgagctgaggcagatgttcccacagtgaccccagagccctgggctatagtctctgacccctccaaggaaagaccaccttctggggacatgggctggagggcaggacctagaggcaccaagggaaggccccattccggggctgttccccgaggaggaagggaaggggctctgtgtgccccccaggaggaagaggccctgagtcctgggatcagacaccccttcacgtgtatccccacacaaatgcaagctcaccaaggtcccctctcagtccccttccctacaccctgaccggccactgccgcacacccacccagagcacgccacccgccatgggagtgtgct

SEQ ID NO: 3777 - DNA, 34 bp, Homo sapiens
ggacatctgtcccagagggggcagaatctccaat

SEQ ID NO: 3778 - DNA, 309 bp, Homo sapiens
agctcggctgaaactcctcatcctggctccaaacagaggcccaaaagtccctggtatcaactccagaaggggcgagacccgaacaagttccaaaccaggcccaaatagtatcccaaactcagtcccaaacacattctcacccccggcagcaggctgcaggcctccagctacacacacggccctgggcaactctcagtctggccacccattcgatgctgccagccccaagggtgtgggaggggggtctcagagtgtcccagggtactggccacacatgcccgacaccagggtcataaggtcctctcagca

SEQ ID NO: 3779 - DNA, 654 bp, Homo sapiens
tgccactgtcctgatactttttaaggtggtctttgaaaaactgtttttttaaaatagccttttagtagagtgagttggcatttgtgatactgtgaaatacacactttctctttgtccctgtttctggcatacaactcctaaaatccttgcaatcttcaaagtgatatattttcatatgctaatgagttcactgatagctggcaggccctaggtagcttcaagataaagtctgatcattgaaaagaccaagacatgattatagggttgggacttacaaccccaaaccctaacctccagagagggcgaagtggatgaagattaagttgatcaccagtgaccagtggtttaatcaagcatgcctatgtaatcaagcctccataaaaaaacaaaaggtcaagatttggagagcttccagattgctgaacatgtggtggttcctgcaggatggcatgcctggagagggcatggaagctctgtgcccacctagacctcaccttatgtttcctgccatctggatcctttgtaacatcctttataatacgtcagtaaatctgtttccttgcattttgtgagctgttgtagcaaattaatagaacacaaaaaggggatcctgggaaaccaaacttgaagctgactagtcttgcaactggtgtc

SEQ ID NO: 3780 - DNA, 79 bp, Homo sapiens
tgcttgctttttcaggattgtgttactatcactaagtagcaaattgcccagcacattagtcctaaacgtcccatgtatt

SEQ ID NO: 3781 - DNA, 998 bp, Homo sapiens
tgctgtgtcgaacaatcaggactgcattcatatgagatccttgtagtataagcacaggccatttttcactttggtattaataaaatgtaaaaaaaaaaaactggctgaatggctgaatgagataaaatttaattttaaaaaatggttatgaaataatgttccaattattaaatttgtattatcccagtggtattcaataaatcaaaatgtgtgaagtaatgggcaatatcaaacttcctgcatatctccatttttgctctaggcaaattaattatccttaaaaaagttaagcatatcttctgaactgaatacatcagctggcataaaaggagcatgaagtctgttaaagccattgtcagcaaagctttgaaaataaaggacttcacaaaaacggtaatgtaaatgtgcttccaagttggggggaaaatgtgtacttaggaaaacatggaaacttagacttgtatagtgtaatgaacacaaataccaaaactgcattttggttttgcctataccatcctgatttttgaaaagtgaattataaacacaaaattgttagtgtttatgatgtttttatcataaaggatgtcagagaaactttatgcatattaaaaatgtaatgtaattataagcgattcccctcaacaatccagagaaagtagttctttaaataagagataatttaaagaaaaataaatactagacatcaaatttagatctggtttatgtcaaaggttttaacactgtacataaatgttcaatttacttttacaaagatcaagaatactgcccattactgtcacaattttccagatattatataatgaactcgtaatgtaacatttccttctagcttcctactgaattgtgagctgttacttgttgaaaaaccatatcacttttctgttgccatgattttttttttttcaacaaaaaaccaaagtgcattgtacgccctttggccagtcttgtatgtgccttgatccaacgctacatgtatt

SEQ ID NO: 3782 - DNA, 1400 bp, Homo sapiens
cctcatcgggactaaaattgggctgttccttcaagtagcacctctatcagttatggctaaatcctgtccatctgtgtgtcgctgcgatgcgggtttcatttactgtaatgatcgctttctgacatccattccaacaggaataccagaggatgctacaactctctaccttcagaacaaccaaataaataatgctgggattccttcagatttgaaaaacttgctgaaagtagaaagaatatacctataccacaacagtttagatgaatttcctaccaacctcccaaagtatgtaaaagagttacatttgcaagaaaataacataaggactatcacttatgattcactttcaaaaattccctatctggaagaattacatttagatgacaactctgtctctgcagttagcatagaagagggagcattccgagacagcaactatctccgactgcttttcctgtcccgtaatcaccttagcacaattccctggggtttgcccaggactatagaagaactacgcttggatgataatcgcatatccactatttcatcaccatctcttcaaggtctcactagtctaaaacgcctggttctagatggaaacctgttgaacaatcatggtttaggtgacaaagttttcttcaacctagttaatttgacagagctgtccctggtgcggaattccctgactgctgcaccagtaaaccttccaggcacaaacctgaggaagctttatcttcaagataaccacatcaatcgggtgcccccaaatgctttttcttatctaaggcagctctatcgactggatatgtccaataataacctaagtaatttacctcagggtatctttgatgatttggacaatataacacaactgattcttcgcaacaatccctggtattgcgggtgcaagatgaaatgggtacgtgactggttacaatcactacctgtgaaggtcaacgtgcgtgggctcatgtgccaagccccagaaaaggttcgtgggatggctattaaggatctcaatgcagaactgtttgattgtaaggacagtgggattgtaagcaccattcagataaccactgcaatacccaacacagtgtatcctgcccaaggacagtggccagctccagtgaccaaacagccagatattaagaaccccaagctcactaaggatcaccaaaccacagggagtccctcaagaaaaacaattacaattactgtgaagtctgtcacctctgataccattcatatctcttggaaacttgctctacctatgactgctttgagactcagctggcttaaactgggccatagcccggcatttggatctataacagaaacaattgtaacaggggaacgcagtgagtacttggtcacagccctggagcctgattcaccctata

SEQ ID NO: 3783 - DNA, 37 bp, Homo sapiens
tctgaagtaacggaagctaccttgtataaagacctca

SEQ ID NO: 3784 - DNA, 43 bp, Homo sapiens
tacctgttcttgtataacgtgactgcaccagacattctgaaaa

SEQ ID NO: 3785 - DNA, 109 bp, Homo sapiens
ctttgtgtggactggacgcagagcttgggagacgggggagggctattactccaattcactgtcaatggaattacagctatagcggcagtgtatataggattgctttttc

SEQ ID NO: 3786 - DNA, 484 bp, Homo sapiens
ttacttccacgttggcctatctgtccccttctccatcctatctgaagccctcgaggcagggaccacgtatctcttaaatacactaataaatgctgaattggtaaatgaatgtttcctaactcaactcccacaagacctgtgctgtcccatagaaataatacatgagccacaaatgcaagccacatatgtaatttagaattttctagtgaccacattgaaaacagtaaaaaagccataggtggaattagctttaataatgtattttatttaatccaatatatccaaaacattatttcaacatgtaatcaatataagaattagtaaggtatttgaccttcttatttttgtactcaatctttgaaatgtggtgtgtgttttatactgacagcaggtctcaatttgaactagctgcatttcaagtgctcggtagccagtctggctagtactggatgaagcaggtctagactgcgattccgtggatgtg

SEQ ID NO: 3787 - DNA, 894 bp, Homo sapiens
cccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaagccataggcccaggatatttctgagagtgaaaccatgactgtgaccaccttctgtccccagccctgtcctggttccttcctatgcccaggtaccacccttcagaccccagttctaggggagaagagccctggacacccctgctctacccatgagcctgcccgctgcaatgcctagacttcccaacagccttagctgccagtgctggtcactaaccaacaaggttggcaccccagctaccccttctttgcagggctaaggcccccaaacatagcccctgccccggaggaagcttggggaacccatgagttgtcagctttgactttatctcctgctctttctacatgactgggcctcccttgggctggaagaattggggattctctattggaggtgagatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttc

SEQ ID NO: 3788 - DNA, 129 bp, Homo sapiens
catttaatcaccatgggaaactgttgtgggcgctgcttccaggataaggagactgaggcttagagagaggaggcagccccctccacaccagtggcctcgtggttattagcaaggctgggtaatgtgaag

SEQ ID NO: 3789 - DNA, 27 bp, Homo sapiens
gtcccctccacatcccagcagcccaag

SEQ ID NO: 3790 - DNA, 308 bp, Homo sapiens
ccaagctagtgagcaaaatatgccccttcttgggccccagaccccagggcagggtgggcagcctatgggggctctcggaaatggaatgtgcccctggcccatctcagcctcctgagcctgtgggtccccactcaccccctttgctgtgaggaatgctctgtgccagaaacagtgggagccctgaccttggctgactggggctggggtgagagaggaaagacctacattccctctcctgcccagatgccctttggaaagccattgaccacccaccatattgtttgatctacttcatagctccttggagc

SEQ ID NO: 3791 - DNA, 94 bp, Homo sapiens
tgccgctccacatgggcctccacaagctggtggtgaacttcgagagcgacaagctgaaggctgtgaagggcttccggaatgtcatcattggccc

SEQ ID NO: 3792 - DNA, 47 bp, Homo sapiens
aaggctgcaccttcactgtggagggggccggcctgactgaggagcag

SEQ ID NO: 3793 - DNA, 92 bp, Homo sapiens
tcctctatgagaaataccgtgactgccttacggagtccaacctcatcaaggtgcgggccctcctcgtggagccagttatcaacagctacctg

SEQ ID NO: 3794 - DNA, 807 bp, Homo sapiens
tggggctaagaaccacacttcagtgggtagctttgttcctgccatcttctttctcatccccatatcactgtgcggcttttgctctgcaacgacccttggtcttacctctgcccagcaggtgataagatctgggaacagagaggaaacagaggggaaacagagaggggaggtcatctccccgggctcacacagccagtgagtggccagacagggcctgaggcaagtctcccaatctgagcacttactggcagaggtgattcttcatctgtgcaacgggtacagcatcacgagcctcgtggagggaaatgaccttatgtccatgagaggcattcttcagtgagtgtggaccatattgttggactctaagatctggattattagtccagatgcctgcacagtacatatcagctgtgtgacctaggacaacgttatttcacctgctggagactcagttttctcatctgtaagttgggtggtaatacacgtacaagccttttagggttgtcatgtaggtgaagtaggagcccgccgtgggaagtgcagtgcctggtgcagcaagcagatgtcggctctgatcctccccaggatgaagggcccgcggctcacacaccctgagtcccgagcgcaccaggctcttccgggacactcgctcagctcatcctcccacagccttaggagtgcctgtgccacgcagatccaaacatcgaggacctgggaggtggagtggctcacgcggggtcacccattagaagaggcaaaggcaggattagaaccaaggcccgtgggagtccaagtgcgtcctctacc

SEQ ID NO: 3795 - DNA, 32 bp, Homo sapiens
gtaaagccctgtgttcctggagcatttgttga

SEQ ID NO: 3796 - DNA, 185 bp, Homo sapiens
gggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatc

SEQ ID NO: 3797 - DNA, 160 bp, Homo sapiens
gcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaa

SEQ ID NO: 3798 - DNA, 76 bp, Homo sapiens
acttccactgctgggtggagtcgtggatgaccaggccggacctgcagccggggtacgagggctggcaggccctgga

SEQ ID NO: 3799 - DNA, 84 bp, Homo sapiens
cgcgtcgtgaccaactacaactcggcccatgaccagaacagcaaccttctcatcgagtacttccgcaatgagtttggggagatc

SEQ ID NO: 3800 - DNA, 268 bp, Homo sapiens
tcagcacagaacctagcccagtgtcactctcggcaaatattagccagtaataactggatcctaacagtaatatcagtgtcaagaaagaaagcatgttctaaaatgtagagggggaatatcgagcaatttaaaaccaaaaaagtaaaataaatctaaaacaaaaatcttcaaaatttaaggccagaaaatgtcgatgattgttgccaggctgatgatggtgcttatgagaatgggttagcatcacatgctggctaagaacgtagactca

SEQ ID NO: 3801 - DNA, 179 bp, Homo sapiens
ctgcacgctgggatgtgggtcatgagccctgggagggggcacgaagagcactggagtaggaatcaggacatccctgccctggtcctgccccctgccaccaacactctcaatgcgctatgtggcctagagcctgtgaccaccctctccggtcctttatccaatagccatccctccagtgg

SEQ ID NO: 3802 - DNA, 116 bp, Homo sapiens
cgctgggacaacaactacggggacggcgtcagccccatgtcctggatcggcagcgtggacatcctgcggcgctggaagaaccacggctgccagcgcgtcaagtatggccagtgctg

SEQ ID NO: 3803 - DNA, 79 bp, Homo sapiens
agatgggatcctagacatctgcctgatccttctagatgtcaaccccaagttcctgaagaacgccggccgtgactgctcc

SEQ ID NO: 3804 - DNA, 85 bp, Homo sapiens
tgctgtgtacctggactcggaagaggagcggcaggagtatgtcctcacccagcagggctttatctaccagggctcggccaagttc

SEQ ID NO: 3805 - DNA, 173 bp, Homo sapiens
tgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcc

SEQ ID NO: 3806 - DNA, 27 bp, Homo sapiens
caaggcccgttttccactaagagatgc

SEQ ID NO: 3807 - DNA, 117 bp, Homo sapiens
ctggagaccaatggccgagaccaccacacggccgacctgtgccgggagaagctggtggtgcgacggggccagcccttctggctgaccctgcactttgagggccgcaactacgaggcc

SEQ ID NO: 3808 - DNA, 41 bp, Homo sapiens
cagccgccagtggtcgcacttggagggtctcgccgccagtg

SEQ ID NO: 3809 - DNA, 26 bp, Homo sapiens
gttagcgccgctctccgcctcggcag

SEQ ID NO: 3810 - DNA, 76 bp, Homo sapiens
caagagaccagagataccaggatgagagataggacccctggttgccaggttcgagaagtcctaggctgagtccctg

SEQ ID NO: 3811 - DNA, 210 bp, Homo sapiens
gctttgacaaaatgactggctcctgacttaacgttctataaatgaatgtgctgaagcaaagtgcccatggtggcggcgaagaagagaaagatgtgttttgttttggactctctgtggtcccttccaatgctgtgggtttccaaccaggggaagggtcccttttgcattgccaagtgccataaccatgagcactactctaccatggttctg

SEQ ID NO: 3812 - DNA, 85 bp, Homo sapiens
ctggttttgcttccccgtgcatgatttactcttagagatgattcagaggtcacttcatttttattaaacagtgaacttgtctggc

SEQ ID NO: 3813 - DNA, 135 bp, Homo sapiens
cctctggtcacttcgaagaacaatatctggtggctgataggggatacaagctggggttctggctgtgccaaagcttacagaccaggagtgtacgggaatgtgatggtattcacggactggatttatcgacaaatg

SEQ ID NO: 3814 - DNA, 138 bp, Homo sapiens
ggtggagattcgaagcccacacagtcactcgtaactcacactgcgacccccgccccccaactcctctaggcctggtcagtggtgtgcggcagattgtgacttgattttctgctctctgtaccttgctgtgtcccacag

SEQ ID NO: 3815 - DNA, 133 bp, Homo sapiens
tcagaagtgctgaacgctgccaaggtgcttctcattgagacacagagatgcaacagcagatatgtctatgacaacctgatcacaccagccatgatctgtgccggcttcctgcaggggaacgtcgattcttgcc

SEQ ID NO: 3816 - DNA, 249 bp, Homo sapiens
tagagccctatagtttcagagctgggaatttctttccctgaagctgaactccagagctgcattcagcacaggcaccgccagttgtaaggagaatccaggtttcccaggagaggggttggtgctgggatgagctgaccggggcagggctggaaaatagggctgtgaccatctgtgtagtgcgtgtggaggtctcagggagggaagtgtgctctccctgcgagagctgcaggcaacactgggagctcaaca

SEQ ID NO: 3817 - DNA, 74 bp, Homo sapiens
aaaccagtgtgtctgcccaacccaggcatgatgctgcagccagaacagctctgctggatttccgggtggggggc

SEQ ID NO: 3818 - DNA, 85 bp, Homo sapiens
aatccatggcattggacggcatttgcggggattttgagacaatctttcatgttctatggagccggataccaagtagaaaaagtga

SEQ ID NO: 3819 - DNA, 84 bp, Homo sapiens
tggcaggtcagcctgcacgtccagaacgtccacgtgtgcggaggctccatcatcacccccgagtggatcgtgacagccgcccac

SEQ ID NO: 3820 - DNA, 28 bp, Homo sapiens
aaagcagtggtttctttacgctgtatag

SEQ ID NO: 3821 - DNA, 91 bp, Homo sapiens
ccaaggaatagtggatgacagcggatccaccagctttatgaaactgaacacaagtgccggcaatgtcgatatctataaaaaactgtaccac

SEQ ID NO: 3822 - DNA, 97 bp, Homo sapiens
aggtgtactcatctcagaggaagtcctggcaccctgtgtgccaagacgactggaacgagaactacgggcgggcggcctgcagggacatgggctataa

SEQ ID NO: 3823 - DNA, 896 bp, Homo sapiens
atgggccttacctcatatacgtgtcttattaagaacacataaaacctactcttgtagtgattttcaaatatgcaacatatagtttattaactgcagtcactatgatgtacaatagattgctcgaacttattcctcctgtctaactaagattttgtgacctctgaccaacatctccccagtgttgtcaccccccgcccccagcctctgatagctgcctttctactctctgcttctgtgagtttgatgtttatacattccacatgtaagtggcctcatgcagtgtttctgtctctgtgtctggcttgttcacttagcgtaatgtcctccagcttcatctatgttgttggaaatgacaggatttccttctttcttgtggctgaatagtattgccttgtgcatatacaccacattttctttatcccttcattcactgatggactcttaggttgatgtcatgtcttggctgttgtgaaaaatgccgcagtgagcgtgggcgtgcaggtccctcttcaacacacggatttcctttcctttggatataaacccagcagtgagattgctggatcacatggcagttctgtttctcaccttttgaggaaactccatactgttttccataatggctgtagcaacttccactcccacccccacggtgcaaagtctccatttctcttctacaacctcaccaactcctgttattttccatctttctgatagtagccatttgaagaggtatgagatgatacctcattgtggttttcatttgcatttttatttgtatttttcatgaatttttgagggtgatttcaagggtagttagtgactcgaacagggaaacgatcctgagtatgagggttgtgctaatcatccccctcctgccagctgcgtacggaatg

SEQ ID NO: 3824 - DNA, 44 bp, Homo sapiens
tgcatcaacccctctaactggtgtgatggcgtgtcacactgccc

SEQ ID NO: 3825 - DNA, 27 bp, Homo sapiens
ctccaactctgggatagagtgcgactc

SEQ ID NO: 3826 - DNA, 33 bp, Homo sapiens
ctgcgctggccgctggcctactctggaagttca

SEQ ID NO: 3827 - DNA, 207 bp, Homo sapiens
ttggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaa

SEQ ID NO: 3828 - DNA, 36 bp, Homo sapiens
cattccagatacctatcattactcgatgctgttgat

SEQ ID NO: 3829 - DNA, 26 bp, Homo sapiens
ccgcccggaggtgaaagcgggtgtga

SEQ ID NO: 3830 - DNA, 355 bp, Homo sapiens
gtgacccgtgcatctttccagcttttccttggccacctgggtggcatgggagctgggagtcagagttctgctgagctgtaggaccaaaggccactggctccgctgcacctgcggactgagacacccacctgctgagtgagacccagcctctgcgtgcttaggggtcccctgctacagggcattgaggtgaggtccgcctttgcccagtgtgagagcgctgctttcagagctttgagaaggctgttatcatttgtttctttttgaacttgccacctccccacttagagaatatttctggggacagagtttcgtaactcctgccgcatagttggtgcctgctctcgactacattaaa

SEQ ID NO: 3831 - DNA, 66 bp, Homo sapiens
caagtggggtctggaccaccgaccttagcttcacctcaacccccaagaacacctgccccgttggag

SEQ ID NO: 3832 - DNA, 126 bp, Homo sapiens
gtcccgccgggcactcggagggcagcgcgccggaggccaaggttgccccgcacggcccggcgggcgagcgagctcgggctgcagcagccccgccggcggcgcgcacggcaactttggagaggcgag

SEQ ID NO: 3833 - DNA, 40 bp, Homo sapiens
atgaccccttggctcgggctcatcgtgctcctgggcagct

SEQ ID NO: 3834 - DNA, 28 bp, Homo sapiens
gcgtgcacatgctcgcccagccaccccc

SEQ ID NO: 3835 - DNA, 115 bp, Homo sapiens
actagccatcagtggaagcgggaaataggacttctatttcttgttgtcaccctcaccagcacccaacccaatgttccagacaccaacctagttcatgcctatgttggtttgattg

SEQ ID NO: 3836 - DNA, 25 bp, Homo sapiens
aggttccaagctcaggctatttggg

SEQ ID NO: 3837 - DNA, 33 bp, Homo sapiens
ctcttgtaaacacaatcatctattccagttggc

SEQ ID NO: 3838 - DNA, 42 bp, Homo sapiens
ggggcccttcggcacgctggtctacaccatcaagcagatgaa

SEQ ID NO: 3839 - DNA, 301 bp, Homo sapiens
gcttatctgtctaatacgggcatgagggtgagaccccacaggcctggaaactccccagaggagacaagccgcaatgtccaggtagaagggagtggaggagtgacgcagcccacggtggtacccaaccatccccaaggccaacctccaggctttcttattcctgtgtcctgaggctggatgtactaattttgtggaacctgttgctttggattcaattttgcaaacatccacagccttctggttatgtaatgtccagagtcagccctggccagttgcccttggctgcctaagcttggtcatg

SEQ ID NO: 3840 - DNA, 298 bp, Homo sapiens
cgggactcaggtcctaaggttgacaaagaaaaaggacctttgtcacagctacttctctggatttctgaaaaggtgctgggatgtcagacatgtgtagccgaaggagtgttgtggggcagttggaatggggggtatggctggctgcacaggaaggtttctctgggaaggcaccaacctggctagtcaagaggatcggtggcttcatctggggtgaagggggccctggggtgggtagatcagtgaccggccactggacagctgaataggggagcgagattccctcagatccaatgtcagc

SEQ ID NO: 3841 - DNA, 277 bp, Homo sapiens
cgcttagcaaaacgacctccagttccagctgcattgccacaaatgacaagatttcattcttttttctggatgaatcatattccattgggtatagataccaggttttgtctatccattcatctgttgatgggcacttaggttgatttcatatcttggctattgtgaatattgctgcagtcaacatgagagtgcagacccctcttccatattccgatttcctttcctttggatacatacccagcagtgggattagggatcatacgggtgtccaaactgg

SEQ ID NO: 3842 - DNA, 89 bp, Homo sapiens
caagatgccccatgtgcagtacatccatacggaagcttccgagagtctctgtggccttaagctggaggtcaacaagtaccagtacctgc

SEQ ID NO: 3843 - DNA, 116 bp, Homo sapiens
gtcgcgtctatgatggcaagatgtacacggggctgtgcaacttcgtggagaggtgggaccagctcaccctctcccagcgcaaggggctgaactatcggtatcacctgggttgtaac

SEQ ID NO: 3844 - DNA, 174 bp, Homo sapiens
caggtctgagcagatatagtaaggattgttgccccaggtggggcagtgaggaaggcagggaaggaagaatgcctttctgctgtaatcggctgcctccatgatgaccacttggaagctgctggggcatgagggctcttgagtccctggccccacctggcagttcaaggctggagg

SEQ ID NO: 3845 - DNA, 124 bp, Homo sapiens
tgtgacttccaagaacgagtgtctctggaccgacatgctctccaatttcggttaccctggctaccagtccaaacactacgcctgcatccggcagaagggcggctactgcagctggtaccgagga

SEQ ID NO: 3846 - DNA, 593 bp, Homo sapiens
aaggccaaccatttcaggatcagtcaaaggcagcaagcagatagactcaaggtgtgtgaaagatgttatacaccaggagctgccactgcatgtcccaaccagactgtgtctgtctgtgtctgcatgtaagagtgagggagggaaggaaggaactacaagagagtcggagatgatgcagcacacacacaattccccagcccagtgatgcttgtgttgaccagatgttcctgagtctggagcaagcacccaggccagaataacagagctttcttagttggtgaagacttaaacatctgcctgaggtcaggaggcaatttgcctgccttgtacaaaagctcaggtgaaagactgagatgaatgtctttcctctccctgcctcccaccagacttcctcctggaaaacgctttggtagatttggccaggagctttcttttatgtaaattggataaatacacacaccatacactatccacagatatagccaagtagatttgggtagaggatactatttccagaatagtgtttagctcacctagggggatatgtttgtatacacatttgcatatacccacatggggacataagctaattt

SEQ ID NO: 3847 - DNA, 256 bp, Homo sapiens
ctcttccctatcatgggtcatctgacccctgtccgtctccttgtccctgcttcatgtttgggggcctttctttaactgccttcctggcttagctcagatggcagatgagagtgtagtcaagggcctgggcacaggagggagagctgcagagtgtcctgcctgccttggctggagggacacctctcctgggtgtggagacagcttggttccctttccctagctccctggtgggtgaatgccacctcctgagatcctc

SEQ ID NO: 3848 - DNA, 1604 bp, Homo sapiens
cggcatcgggtttccttgggatcaatttcattaccgtgtacctttcccattgtggtcatgccatttggcagggggagaatgggaggcttggccttctttgtgaggcagtgtgagcagaagctgatgccagcatgtcactggttttgaagggatgagcccagacttgatgttttgggattgtccttattttaacctcaaggtctcgcatggtggggcccctgaccaacctacacaagttccctcccacaagtggacatcagtgtcttctctgtgaggcatctggccattcgcactccctggtgtggtcagcctctctcacacaaggaggaacttgggtgaaggctgagtgtgaggcacctgaagtttccctgcggagtcgataaattagcagaaccacatccccatctgttaggccttggtgaggaggccctgggcaaagaagggtctttcgcaaagcgatgtcagagggcggttttgagctttctataagctatagctttgtttatttcacccgttcacttactgtataatttaaaatcatttatgtagctgagacacttctgtatttcaatcatatcatgaacattttattttgctaaatcttgtgtcatgtgtaggctgtaatatgtgtacattgtgtttaagagaaaaatgaaacccacatgccgccattttcctgaatcaaattctgcagtggaatggagaggaaaatacttctaggcaagcagctagactggtgaattgggggaaatagaaggaactagtaactgagactcctccagcctcctccctattggaatcccaatggctcctggagtaggaaaaaagtttaaactacattcatgttcttgttctgtgtcactcggccctgggtagtctaccatttacttcaccccaagtcctgctgcccatccagttgggaagccatgattttcctaagaatccagggccatgggagatacaattccaagttctcgcttcctcctttgggcatctcttctgcctcccaatcaaggaagctccatgctcaggctctcagctctcgggccagtgctctgctctgtccagggtaggtaatactgggagactcctgtcttttaccctcccctcgttccagacctgcctcatggtggcaacatggttcttgaacaattaaagaaacaaatgactttttggaatagccctgtctagggcaaactgtggcccccaggagacactacccttccatgccccagacctctgtcttgcatgtgacaattgacaatctggactaccccaagatggcacccaagtgtttggcttctggctacctaaggttaacatgtcactagagtatttttatgagagacaaacattataaaaatctgatggcaaaagcaaaacaaaatggaaagtaggggaggtggatgtgacaacaacttccaaattggctctttggaggcgagaggaaggggagaacttggagaatagtttttgctttgggggtagaggcttcttagattctcccagcatccgcctttccctttagccagtctgctgtcctgaaacccagaagtgatggagagaaaccaacaagagatctcgaaccctgtctagaaggaatg

SEQ ID NO: 3849 - DNA, 107 bp, Homo sapiens
tgggaacagatttgctgtctgcaaaggctgcatctgcgggtctggcgtgcaaaggagggtggttctttggctaatggtggacttgctcctaggcctatcccagagtc

SEQ ID NO: 3850 - DNA, 32 bp, Homo sapiens
ccgccccgcgctctggcggctcctcccgggcg

SEQ ID NO: 3851 - DNA, 118 bp, Homo sapiens
gccagtgtgactttcgccaccaacaaccccacacttaccactgtggccttggaaaagcctctctgcatgtttgacagcaaagaggccctcactggcacccacgaggtctacctgtatg

SEQ ID NO: 3852 - DNA, 173 bp, Homo sapiens
ccaggaatgcctcagtgcaagacagcaccaacaccccactgggctcaacgttcctacaaacagagggtgggaggacaggtccctacaaagctgtggcctttgacctgatcccctgcagtgacctgcccagcctggatgccattggggatgtgtccaaggcctcacagatcctg

SEQ ID NO: 3853 - DNA, 71 bp, Homo sapiens
tcctggtcaatatgtccacgggcttggtagaggaccagaccctgtggtcagaccccatccgcaccaaccag

SEQ ID NO: 3854 - DNA, 113 bp, Homo sapiens
ctcgacgatcgacacgtggccaggccggcggagcggaggcatgatcgtcatcacttccatcctgggctccctgcccttctttctacttgtgggttttgctggcgccattgccc

SEQ ID NO: 3855 - DNA, 96 bp, Homo sapiens
agttctgatggggaaacgactcacgactcccaaatcactcaggaggctgttcccaagtcgctgggggcctcggagtcttcctacacgtccgtgaac

SEQ ID NO: 3856 - DNA, 27 bp, Homo sapiens
gtgtattccagcaagctccaagactga

SEQ ID NO: 3857 - DNA, 34 bp, Homo sapiens
gccctgcagcggtggttgtcacaccctgacttca

SEQ ID NO: 3858 - DNA, 402 bp, Homo sapiens
gctgccttgggacataggtacctgaggtacctgagagcccctcaggggaggaggccgagtggctgtggctgaggcccccaccctcccctggaacgcgccccaagccggagtgggtgcagccggaacccgcccagcgtctagactgtagcatcttcctctgagcaataccgccgggcaccgcaccagcaccagccccagccccagctccctccggccgcagaaccagcatcgggtgttcactgtcgagtctccagtgatttgaaaatgtgccttacgctgccacgctgggggcagctggcctccgcctccgcccacgcaccagcagccgcctccatgccctaggttgggcccctgggggatctgagggcctgtggcccccagggcaagttcccagatcctatg

SEQ ID NO: 3859 - DNA, 69 bp, Homo sapiens
acggactccttgaacaccctcgtggcactccaccagctctaccaatacacgcagaagtactatgacgag

SEQ ID NO: 3860 - DNA, 46 bp, Homo sapiens
tactacaaggggatccggcagatggtgcaggtcagcgaccaggaca

SEQ ID NO: 3861 - DNA, 25 bp, Homo sapiens
agctgctgtacgccaaggagatctc

SEQ ID NO: 3862 - DNA, 177 bp, Homo sapiens
ttggccaagcctccagcagctgacgggacccagctgtagtgaggttgcagtgattgagtaggattggcctgcttcaaagcagaggtttctcatgggaatatgcttattaaactcccactggtgcagaaaccatgaacagaggatgaacaagtgaagttgcaatctcctccatcacag

SEQ ID NO: 3863 - DNA, 31 bp, Homo sapiens
agttccccaacaacaggatcacaagctggag

SEQ ID NO: 3864 - DNA, 72 bp, Homo sapiens
tgggaagccgagagccacgcagcatcaaggccgaacatcatcctggtgatggctgacgacctcggcattgga

SEQ ID NO: 3865 - DNA, 103 bp, Homo sapiens
caatatcgaccggttggccagtgggggagtgaaactcactcagcacctggcagcatcaccgctgtgcacaccaagcagggcagccttcatgactggccggtac

SEQ ID NO: 3866 - DNA, 42 bp, Homo sapiens
gaatggcatcttggtcccgcactggagttttcctcttcacag

SEQ ID NO: 3867 - DNA, 53 bp, Homo sapiens
tcttcgggaggacttcccaccgatgagattacctttgctaagcttctgaagga

SEQ ID NO: 3868 - DNA, 107 bp, Homo sapiens
tgagctgtcacagcaagactgacttctgtcaccaccctttacatcacggcttcaattatttctatgggatctctttgaccaatctgagagactgcaagcccggagag

SEQ ID NO: 3869 - DNA, 33 bp, Homo sapiens
gctactccacgtgcctctaggcgtttttttcag

SEQ ID NO: 3870 - DNA, 31 bp, Homo sapiens
gaacactgagactccgttcctgcttgtcttg

SEQ ID NO: 3871 - DNA, 29 bp, Homo sapiens
caaaagtcaacacggagtctacggggatg

SEQ ID NO: 3872 - DNA, 108 bp, Homo sapiens
gctgagattggctaatgataccctcatctacttcacatcggaccagggagcacatgtagaagaagtgtcttccaaaggagaaattcatggcggaagtaatgggatcta

SEQ ID NO: 3873 - DNA, 102 bp, Homo sapiens
cttcgttggcccagggtgatacaggctggccagaagattgatgagcccactagcaacatggacatatttcctacagtagccaagctggctggagctcccttg

SEQ ID NO: 3874 - DNA, 106 bp, Homo sapiens
cattgatggacgtgatctgatgcccctgcttgaaggaaaaagccaacgctccgatcatgagtttctcttccattactgcaacgcctacttaaatgctgtgcgctgg

SEQ ID NO: 3875 - DNA, 109 bp, Homo sapiens
catctggaaggcctttttcttcacccccaacttcaaccccgtgggttccaacggatgctttgccacacacgtgtgcttctgtttcgggagttatgtcacccatcacgac

SEQ ID NO: 3876 - DNA, 122 bp, Homo sapiens
gtgcccgatcagttttcatggaacaactttctttggaagccctggcttcagctgtgctgtccttccaccggcctgtcttgccagtgtgatagagaaaaacaggataagagactgagccgcta

SEQ ID NO: 3877 - DNA, 426 bp, Homo sapiens
agacagacgcatgtggcaaagctcaccatcttcactacaaacacgcctgagagtggcactggggaaacataactccatctacaccttggatttggactgattctccattttatcacctgaaggcttgggccagagctcaacagctactcaactggaggggtgagggggataaggtctgtagtatacagacaggaagatggtaggtttatgccttctgtggccagagtcttggactcatggaaatagaatgaatagaggggcattcacaaggcacaccagtgcaagcagatgacaaaaaggtgcagaaggcaatcttaaaacagaaaggtgcaggaggtaccttaactcacccctcagcaaatacctatgtcaacagtataagttaccatttactctataatctgcagtgatgcaataaccagcata

SEQ ID NO: 3878 - DNA, 418 bp, Homo sapiens
ttggaaggcaagtcattattactggtattagttaaaacacatatcaaatgcttgctcttcatcatatatatagttatgcatacatacacacacacacatacagtatattctttcctcaaaagggttaagatgtctaaaatagggacctagaagcttaacactatttaagtaaatacagtagaagctcacaaatagatttctttgcacaatgattttttgcaaaattttacagtaataataatcccaaggcaaatctctcctgaactgctttccattccataatttgtagtataattcttggattccactgttttctttggggaatggaagttctgaattaaaagcccactgtggagatgctgtggttcatggaatctcttccagtgtaattcagaatcattggcctagaaagtctctg

SEQ ID NO: 3879 - DNA, 64 bp, Homo sapiens
atgcaagttttgtgactgagaaatttctgtgcttccaatccacaatgagatgcatgattttgtt

SEQ ID NO: 3880 - DNA, 246 bp, Homo sapiens
aatgcgcaactgatcgcctaggagagggcctcgtagtggcacagctggagatagtttcaaagtctaaaccaccagcccatcctgaggaaagcctcctatggaatgtaaagtgcaatcatttcttcagatataagactttccccaacaatgtgattggattcctttatggcaaaatcgagagaagctgccatccacctgcttatgcatttatctcttttgtggacttgtctgaccaccttctatttg

SEQ ID NO: 3881 - DNA, 962 bp, Homo sapiens
cccacacagcggtttgcagagaatgttagccatgacttgggctttctgaaagttggctataatttctctatccctacccacaaccctgggaagttggagcaagaggggcatactattgggctgggaggatttgacagcatttccccagttgccctttaagttcttctatttcaaacgttaattttgcttctctttctaaaaaaaaaaaaaaaaaagaaagagaagaaagaagtgattcctaccccctacctccagagttgttgaaagctgaaaagcatacaagattcttccttttaacttggatttctcgttccagaaattgtgggataatctgtattcttgctttagaaaacattcttagagagggtactagcttactgatgatgtgttaggattgctactgatgctgtcatgtggaaactatttaaaggcactattataaatttatcctataagatgacaatgtttactcaaagtctaacatattcaatgcaagtaagactttctgaaaacacttgatgatgtggaaatgctgcaggattaaataacttgaagagcctttatagattatatgaatgcctatttgtgtctagaaccagttatttaacctgtaaaatgtcaatagcaaatgaaggatgaagtatatctctagatgcaaatacattgagtttaaaagtgcctcaaaataattgagatcacatttcaggacatttggaaatcaggtcgatttgtggtaactgtagtcatcttaaatttcaaaccatttaccatctgaaagttttgatttgaatgtaaaacaggaaattggaattcctttgtccaggagaaacctcacaaaccttctttaaggcatagttttgttgtttgtttgcttgtttgttgcaggctgtaaggcatggctgcttgtttacaaagcatctcattcatattacctgtggagttgcatatccaaaccttagtga

SEQ ID NO: 3882 - DNA, 1139 bp, Homo sapiens
ctccgacctccatgatccgagagtgggaaaaggcccgattattacccataaggcacactctctaaggccttttaaggggcctacaaaaatgttttattttataatcagaagaaaaggaaatgaacattggggattgaaaatcatattggtatttgcaccaacatagtcataaaatagtatgttaatatgtttttactttatatatttatatattaaaatatatttaatatgttttgcctttgtggcccatgaaagtcttactgggccctggggaaggtatcctaccctggtgaagcagctgctttgctctacaaatacctggggcagaaatttgatttgaaaagtattattctctcttctctttgtttcaactggattcctttggaaaaccaaactagtatcagaacaaaccccgaaacagtaagaaattggagtgagaagggcatggtattgggactaggatcggctctcattcgatcgagctattctcttaaaatgacaaaaagtgtccataaagaggctgctggagagtgcgtggccatagggagccgacatgcccgggaggaaaggtgttgattacatggatacttctaaaagctaaagccttgttgccttctctttaatgcctagagaatgggatgtgtgatgcaaatgctcaaaacctcttaaatcatagctgtctgacctctacggacctcacatccatctgaggcttcatggacaaagattctccacttggccaaactttagccaagctcctcaaccttctcccaggcccaatctgggcacttccttgtaaaatctagttttggcaagaagtctattaggtcagtttagcaagaacacctaacccccccatatctgttcaacctcagtatctgatcaggctcctcagcctccaccatcccccaggtgatgtctggtcaactggcctgccttcagctagaatcctgttaggtcggtttagatgaatgctccctgatatttcctcttggtaatcttccatccactgcccctgaccctgttccctgtctataaatccccagttttccatggtgtattcagagctgagtccagtctctctcccctactacaagtccccattgctgtggtccccgtacctgtcatgatggtcctaa

SEQ ID NO: 3883 - DNA, 98 bp, Homo sapiens
gaaacctattgggacagcatgactgtgcagggtctttagagctcagctttctgaggccctgagcattcttggttttccgacatcgtgaacctgttctg

SEQ ID NO: 3884 - DNA, 79 bp, Homo sapiens
gctttccttgttagaatgcaagcagcttaaaaactacccatgtctttctggaaaggaaacattgccatgtaactatgta

SEQ ID NO: 3885 - DNA, 28 bp, Homo sapiens
ctcctcctactgttcaagtacaggggcc

SEQ ID NO: 3886 - DNA, 41 bp, Homo sapiens
cgcccagccactgccgccgactgcagtgacatactgcggct

SEQ ID NO: 3887 - DNA, 28 bp, Homo sapiens
atggaagaacaagtaatcttaactgaaa

SEQ ID NO: 3888 - DNA, 71 bp, Homo sapiens
caacagtggcgggacgggggacaagcgttcggtgcctgtcaccttcgccaaggccattaccgcccctgctc

SEQ ID NO: 3889 - DNA, 36 bp, Homo sapiens
ccttttaccactgcctggttgcagaagtgccgaaag

SEQ ID NO: 3890 - DNA, 147 bp, Homo sapiens
gtcggctgtgtagaaccactgactacacaggccgaagttactgagaacttggacagaaaaaatagccagcaagtgttcaaactactgaggaaaaaaaaaaattagatatgctgcacttaagaatactagggcaggttaaaagagctg

SEQ ID NO: 3891 - DNA, 180 bp, Homo sapiens
gactcggaagtgtttaagctgcttaagtaagtataagtgctgtggagacccggaagagttagatataatgtcatttgttgtaattcagtttcataaaatggttcttgtttgaccctaacgtaacagtttttgtaattgtgttaaatcacatttttttctttaatttgtcccaatcttcag

SEQ ID NO: 3892 - DNA, 42 bp, Homo sapiens
gttacagtctctagcttcgccatgtacatggcccttccgtgt

SEQ ID NO: 3893 - DNA, 44 bp, Homo sapiens
ctaaaagatcctttacacaataaagtagatgatcatgataaatg

SEQ ID NO: 3894 - DNA, 180 bp, Homo sapiens
gtgtgctttttgcaaatacatgttctcagaacagtgagatcatccagcagtggcctggactgcactcacataaaaatcatgagacagccatggctacttgtttctgtaatacatgcatgtgtgttttttaaaacctatgataggcctctgattctgcagctgcaacttttatggaatgtt

SEQ ID NO: 3895 - DNA, 73 bp, Homo sapiens
ctattttacctatgacccgtggattggcaagttattgtatcttgaggacttcttcgtgatgagtgattataga

SEQ ID NO: 3896 - DNA, 57 bp, Homo sapiens
gttcggagcagagggtctgaagagagttcagagttataaatgcttacaatgactttt

SEQ ID NO: 3897 - DNA, 26 bp, Homo sapiens
gctttggcataggatcagaaattctg

SEQ ID NO: 3898 - DNA, 143 bp, Homo sapiens
tgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtact

SEQ ID NO: 3899 - DNA, 31 bp, Homo sapiens
ggagtgctgctgtagatgacaacctccattc

SEQ ID NO: 3900 - DNA, 213 bp, Homo sapiens
ttccaaagctttattaccagtggcgttgttgcatgtttgaaatgaggtctgtttaaagtggcaatctcagatgcagtttggagagtcagatctttctccttgaatatctttcgataaacaacaaggtggtgtgatcttaatatatttgaaaaaaacttcattctcgtgagtcatttaaatgtgtacaatgtacacactggtacttagagtttc

SEQ ID NO: 3901 - DNA, 132 bp, Homo sapiens
tgagtaatgcatccaggaagcctggaggcctgtggtttccgcacccgctgccacccccgcccctagcgtggacatttatcctctagcgctcaggccctgccgccatcgccgcagatccagcgcccagagaga

SEQ ID NO: 3902 - DNA, 73 bp, Homo sapiens
atcagggccaagttcgtggggacaccagaagtcaaccagaccaccttataccagcgttatgagatcaagatga

SEQ ID NO: 3903 - DNA, 92 bp, Homo sapiens
atgtataaagggttccaagccttaggggatgccgctgacatccggttcgtctacacccccgccatggagagtgtctgcggatacttccacag

SEQ ID NO: 3904 - DNA, 27 bp, Homo sapiens
gtcccacaaccgcagcgaggagtttct

SEQ ID NO: 3905 - DNA, 145 bp, Homo sapiens
ctggggcgcggcctagcaaccacgagggggcgaggctctgatgggaatggtcccactggaaatggggaccaccccaatttcagtctatcagaaggccgggcctttggcagcttggcagctcagccaatcacaagctgcttgtcgg

SEQ ID NO: 3906 - DNA, 103 bp, Homo sapiens
ctgcaggatggactcttgcacatcactacctgcagttttgtggctccctggaacagcctgagcttagctcagcgccggggcttcaccaagacctacactgttg

SEQ ID NO: 3907 - DNA, 32 bp, Homo sapiens
tggaccctgacctccaacgggagatccttccc

SEQ ID NO: 3908 - DNA, 102 bp, Homo sapiens
gcccgagactgctcccttacaaattctggctgctccctttccctgtgtccaataccgtgtgatcacctgtccctccctggtccctctaattctcccttgtga

SEQ ID NO: 3909 - DNA, 25 bp, Homo sapiens
tttccctgtttatccatcccctgca

SEQ ID NO: 3910 - DNA, 27 bp, Homo sapiens
cttccagtcccgtcaccttgcctgcct

SEQ ID NO: 3911 - DNA, 26 bp, Homo sapiens
agtccctgcggtcccagatagcctga

SEQ ID NO: 3912 - DNA, 54 bp, Homo sapiens
gcctgcacagtgtccaccctgttcccactcccatctttcttccggacaatgaaa

SEQ ID NO: 3913 - DNA, 91 bp, Homo sapiens
atggcggattctgagcgcctctcggctcctggctgctgggccgcctgcaccaacttctcgcgcactcgaaagggaatcctcctgtttgctg

SEQ ID NO: 3914 - DNA, 128 bp, Homo sapiens
tgatctgcttcagtgcctccacaccaggctactcctccctgtcggtgattgagatgatccttgctgctattttctttgttgtctacatgtgtgacctgcacaccaagataccattcatcaactggccc

SEQ ID NO: 3915 - DNA, 64 bp, Homo sapiens
gatttcttccgaaccctcatagcggcaatcctctacctgatcacctccattgttgtccttgttg

SEQ ID NO: 3916 - DNA, 137 bp, Homo sapiens
tttgaggagccagggaccatttctgcctttgcttctggcagaaatcgtgtgacccacagcaagtcacacttgtcctcagacatggaggaaagtctggcccaggacttggttttgcctcccaaggtcttcatttgctg

SEQ ID NO: 3917 - DNA, 81 bp, Homo sapiens
gtactgggcctaatcgctacgtgcctctttggctatgatgcctatgtcaccttccccgttcggcagccaagacatacagca

SEQ ID NO: 3918 - DNA, 168 bp, Homo sapiens
ccatatgtgtgtgcctaggtcctccttctgcacgatccaataggagacaccagttctgactgaaccatgcccccacctaagtcacaaaatgagggaagtggggagttagatttcagagtccaggccctaggttgggacccactccaaataatctcctcggtgtgggtg

SEQ ID NO: 3919 - DNA, 56 bp, Homo sapiens
tggagtggaaacagctggggcaaggaggcaaagaagccaggcctgttttacaacaa

SEQ ID NO: 3920 - DNA, 42 bp, Homo sapiens
atgcgccagtctgtggagaacgacatccatgggctccgcaag

SEQ ID NO: 3921 - DNA, 38 bp, Homo sapiens
cggcggcgcacctcgcgtcaagaatccggaggaggaga

SEQ ID NO: 3922 - DNA, 208 bp, Homo sapiens
tccaaagaggaactagcggcaaacaatctcaacggggaaaatgcccaacaagaaaacgaaggaggggagcaggcccccacgcagaatgaagaagaatcccgccatttgggagggggtgaaggccagaagcctggaggaaatatcaggcgggggcgagttaggcgacttgtccctaattttcgatgggccatacctaataggcatattg

SEQ ID NO: 3923 - DNA, 72 bp, Homo sapiens
gcagatgaggcactatatgcgcttccaaactcctgaacctgacaaccattatgacttttgcctcataccttg

SEQ ID NO: 3924 - DNA, 386 bp, Homo sapiens
ttgtctcagcctaaaagttacggtcagcatggcaattcacctattttaggaaaaatactcttttcataatatgaaatgcataaagcagttcaaaaagcagtctgtattccatcatcttcctttttcattccagtccttatttttgtaagtattacttttcctcctccggctacctggactcaaaatctcagttgtctttgacagtttttttcttgtccctgaccaaaaaagaatgatcatacccagaattcaatgtttgatattttaagaatgtatgttctagtgtttttcagagtgagtctaccatctgtataaaaacaccttgggggcaggcaggggcatttaaaaatgtaggacctatcgtccagactcacagagtggggctc

SEQ ID NO: 3925 - DNA, 40 bp, Homo sapiens
agtgaaatagagctgatgtatccagaggttatgttgctag

SEQ ID NO: 3926 - DNA, 89 bp, Homo sapiens
gtgagatcagttacctacgtgcaactgaaatttcaaacttctgttcagcagggacgtgagtggacaatggtgactgatagttggaaata

SEQ ID NO: 3927 - DNA, 26 bp, Homo sapiens
atgaaccaggagaataggtccagttt

SEQ ID NO: 3928 - DNA, 238 bp, Homo sapiens
tggcgtttatggattagcttcaccagtggctaatgctatgggagtggtaggcatccctaagaacaataactaccaagcttgtgaccacaacactgagtttagtaatactaagaagccctggattgcgctgatagaaagaggtaattgtacattttcagaaaaaattcaaacagcgggcagaagaaatgctgatgctgttgtgatttacaatgctccagagactggcaatcagacgata

SEQ ID NO: 3929 - DNA, 125 bp, Homo sapiens
ggcaacctgtgtgctgacgctacgtgcctcctggctccgacgtagctcgcagctccccagtctcactccattccttccccacctggcgcgcacctgctcaagaccagggtcctgccaagcgctag

SEQ ID NO: 3930 - DNA, 30 bp, Homo sapiens
gcggtggctgcggcttttccagattgctgg

SEQ ID NO: 3931 - DNA, 146 bp, Homo sapiens
cgaatttcacggtgcccacggtttggggaagcaccgtgcaagtctcttggttggccctcatccaacgcggcgggggctgcaccttcgcagacaagatccatctggcttatgagagaggggcgtctggagccgtcatctttaacttc

SEQ ID NO: 3932 - DNA, 52 bp, Homo sapiens
ggcacaaaaattctgcaatctattcaaagaggcatacaagtgacaatggtca

SEQ ID NO: 3933 - DNA, 122 bp, Homo sapiens
aacatggcccttgggtgaatcactattcaatttttttcgtttctgtgtccttttttattattacggcggcaactgtgggctattttatcttttattctgctcgaaggctacggaatgcaaga

SEQ ID NO: 3934 - DNA, 40 bp, Homo sapiens
aagctattggaaggcttcaactacgcacactgaaacaagg

SEQ ID NO: 3935 - DNA, 66 bp, Homo sapiens
atgtgttgacccatggctgttagaacacaggacttgccccatgtgcaaatgtgacatactcaaagc

SEQ ID NO: 3936 - DNA, 147 bp, Homo sapiens
gtgtctttacaagtccctgtatccaatgaaatatctaatagtgcctcctcccatgaagaggataatcgcagcgagaccgcatcatctggatatgcttcagtacagggaacagatgaaccgcctctggaggaacacgtgcagtcaaca

SEQ ID NO: 3937 - DNA, 77 bp, Homo sapiens
ctgtggcagtggatgttattcctcatgttgacaacccaacctttgaagaagacgaaactcctaatcaagagactgct

SEQ ID NO: 3938 - DNA, 975 bp, Homo sapiens
gccaatcagggcctagtttctattaataaattggataaatttaataaaataagagtgatactgaaagtgctcagatgactaatattatgctatagttaaatggcttaaaatatttaacctgttaacttttttccacaaactcattataatatttttcataggcaagtttcctctcagtagtgataacaacatttttagacattcaaaactgtcttcaagaagtcacgtttttcatttataacaattttcttataaaaacatgttgcttttaaaatgtggagtagctgtaatcactttattttatgatagtatcttaatgaaaaatactacttctttagcttgggctacatgtgtcagggtttttctccaggtgcttatattgatctggaattgtaatgtaaaaagcaatgcaaacttaggcgagtacttcttgaaatgtctatttaagctgctttaagttaatagaaaagattaaagcaaaatattcatttttactttttcttatttttaaaattaggctgaatgtacttcatgtgatttgtcaaccatagtttatcagagattatggacttaattgattggtatattagtgacatcaacttgacacaagattagacaaaaaattccttacaaaaatactgtgtaactatttctcaaacttgtgggatttttcaaaagctcagtatatgaatcatcatactgtttgaaattgctaatgacagagtaagtaacactaatattggtcattgatcttcgttcatgaattagtctacagaaaaaaaatgttctgtaaaattagtctgttgaaaatgttttccaaacaatgttactttgaaaattgagtttatgtttgacctaaatgggctaaaattacattagataaactaaaattctgtccgtgtaactataaattttgtgaatgcattttcctggtgtttgaaaaagaagggggggagaattccaggtgccttaata

SEQ ID NO: 3939 - DNA, 69 bp, Homo sapiens
gtgggggtacaaatcctcagctcctgcttccgcaagcactaacctgctctgaagtgagccaggcagctc

SEQ ID NO: 3940 - DNA, 25 bp, Homo sapiens
ctgtcacctgtgtcattcactcaca

SEQ ID NO: 3941 - DNA, 117 bp, Homo sapiens
gaagactgccatccggctgcccaaaggcaaacagaagcctataaagacggaatggaattcccggtgtgtccttttcacctacttccaaggggacatcagcagcgtagtggatgaaca

SEQ ID NO: 3942 - DNA, 120 bp, Homo sapiens
tggcgttactcgtctccatggacaaagccacaaccagaagtacctgtcacaaaccgtgccgccaactgcaacttgcatgtgcctggtcccatggctgtgaatcagttctcaccgtccctg

SEQ ID NO: 3943 - DNA, 77 bp, Homo sapiens
agcaagacagatgcctagcccgtcctcaggaatctgccgccagggagaatggcaaccctggccagatagctggaagc

SEQ ID NO: 3944 - DNA, 249 bp, Homo sapiens
aggtcttcatgctctactcatgttgacatgagttgtattaattggtgactggaagtccaggatctgttgaggaagtcagtgacccttaatcaggaacactgccttggaaggtggtggacctttaaaacagaagcttctcagtttttgtagcatctgatatgagagaatatgctagatattcataaacttagggccaggcaatgtggggcccctggaatgctactgggcactctctaacctagtcctaga

SEQ ID NO: 3945 - DNA, 39 bp, Homo sapiens
agaaactatatgtatctcgtggatctgccagtaccagcc

SEQ ID NO: 3946 - DNA, 62 bp, Homo sapiens
cctgggaaatactcacttacaccaccaaaccactggggccacccacatcgatacctgcagca

SEQ ID NO: 3947 - DNA, 60 bp, Homo sapiens
gagaaagacaacacttggtctaagacacggcagcaagacatccctgcatattgttccaga

SEQ ID NO: 3948 - DNA, 95 bp, Homo sapiens
acttgcctccccaatctgttaaacagcttcgtgtctagtatgagctcagtacttgccctgtgaaaatcccagaagcccccgctgtcaatgttccc

SEQ ID NO: 3949 - DNA, 91 bp, Homo sapiens
agtagctgctttcggtccgccggacacaccggacagatagacgtgcggacggcccaccaccccagcccgccaactagtcagcctgcgcctg

SEQ ID NO: 3950 - DNA, 33 bp, Homo sapiens
cctgtggcgcctcgtgtctctgctggccctgag

SEQ ID NO: 3951 - DNA, 63 bp, Homo sapiens
ggacttcaccctggacgatgggccattcatgatgaacgatgaggaagcttcgggcgctgacac

SEQ ID NO: 3952 - DNA, 25 bp, Homo sapiens
gggcgtcctggacccggactctgtc

SEQ ID NO: 3953 - DNA, 51 bp, Homo sapiens
gtgtcctttcggctgccactgccacctgcgggtggttcagtgctccgacct

SEQ ID NO: 3954 - DNA, 27 bp, Homo sapiens
aaagagatctcccctgacaccacgctg

SEQ ID NO: 3955 - DNA, 37 bp, Homo sapiens
tgcagaacaacgacatctccgagctccgcaaggatga

SEQ ID NO: 3956 - DNA, 27 bp, Homo sapiens
accagcaggcctacagcagagggcagg

SEQ ID NO: 3957 - DNA, 66 bp, Homo sapiens
gccctcgtcctggtgaacaacaagatctccaagatccatgagaaggccttcagcccactgcggaag

SEQ ID NO: 3958 - DNA, 83 bp, Homo sapiens
atgggcgggaacccactggagaacagtggctttgaacctggagccttcgatggcctgaagctcaactacctgcgcatctcaga

SEQ ID NO: 3959 - DNA, 80 bp, Homo sapiens
agaccctgaatgaactccacctagaccacaacaaaatccaggccatcgaactggaggacctgcttcgctactccaagctg

SEQ ID NO: 3960 - DNA, 113 bp, Homo sapiens
gggcctaggccacaaccagatcaggatgatcgagaacgggagcctgagcttcctgcccaccctccgggagctccacttggacaacaacaagttggccagggtgccctcagggc

SEQ ID NO: 3961 - DNA, 146 bp, Homo sapiens
gtggtctatctgcactccaacaacatcaccaaagtgggtgtcaacgacttctgtcccatgggcttcggggtgaagcgggcctactacaacggcatcagcctcttcaacaaccccgtgccctactgggaggtgcagccggccacttt

SEQ ID NO: 3962 - DNA, 194 bp, Homo sapiens
ggggaacacagccagacatcctgatggggaggcagagccaggaagctaagccagggcccagctgcgtccaacccagccccccacctcgggtccctgaccccagctcgatgccccatcaccgcctctccctggctcccaagggtgcaggtgggcgcaaggcccggcccccatcacatgttcccttggcctcagag

SEQ ID NO: 3963 - DNA, 655 bp, Homo sapiens
tccagtcctaggagaacagtccctgggtcagcagccaggaggcggtccataagaatggggacagtgggctctgccagggctgccgcacctgtccagacacacatgttctgttcctcctcctcatgcatttccagcctttcaaccctccccgactctgcggctcccctcagcccccttgcaagttcatggcctgtccctcccagacccctgctccactggcccttcgaccagtcctcccttctgttctctctttccccgtccttcctctctctctctctctctctctctctctctttctgtgtgtgtgtgtgtgtgtgtgtgtgtgtgtgtgtgtgtgtgtgtcttgtgcttcctcagacctttctcgcttctgagcttggtggcctgttccctccatctctccgaacctggcttcgcctgtccctttcactccacaccctctggccttctgccttgagctgggactgctttctgtctgtccggcctgcacccagcccctgcccacaaaaccccagggacagcagtctccccagcctgccctgctcaggccttgcccccaaacctgtactgtcccggaggaggttgggaggtggaggcccagcatcccgcgcagatgacaccatcaaccgccagagtcccagacaccggttttcct

SEQ ID NO: 3964 - DNA, 36 bp, Homo sapiens
gggctgcttctgaggtcggtggctgtctttccatta

SEQ ID NO: 3965 - DNA, 104 bp, Homo sapiens
ctgccctgtgccgtgctgcgctcacctgcctccccagccagccgctgacctctcggctttcacttgggcagagggagccatttggtggcgctgcttgtcttctt

SEQ ID NO: 3966 - DNA, 121 bp, Homo sapiens
ggaccccctgcgaggagatcctggtgaagcacgtgggcagccggctctacagcgtgtcctacctgctcaaggacaagggggagtacacactggtggtcaaatggggggacgagcacatccc

SEQ ID NO: 3967 - DNA, 176 bp, Homo sapiens
ctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagc

SEQ ID NO: 3968 - DNA, 159 bp, Homo sapiens
cgtgaacacgagcaatgcgggagctggtgccctgtcggtgaccattgacggcccctccaaggtgaagatggattgccaggagtgccctgagggctaccgcgtcacctatacccccatggcacctggcagctacctcatctccatcaagtacggcggccc

SEQ ID NO: 3969 - DNA, 126 bp, Homo sapiens
gtaagtctgtcggtgcggctgcacgtgtgcacacagctgctaggcccttgcctccaagctcttggtgacaacaggaggcacctggaggtgacaagcctgtgctgggtggccgaggacagggaggca

SEQ ID NO: 3970 - DNA, 146 bp, Homo sapiens
gaatggcgtttacctgattgacgtcaagttcaacggcacccacatccctggaagccccttcaagatccgagttggggagcctgggcatggaggggacccaggcttggtgtctgcttacggagcaggtctggaaggcggtgtcacag

SEQ ID NO: 3971 - DNA, 60 bp, Homo sapiens
acaccatctgctggtttgaggaggggccccaggcccacagcatgactccctgctcctcag

SEQ ID NO: 3972 - DNA, 381 bp, Homo sapiens
tggctcgccacccacagctattaggaaggccttctaccctgcagtaccatgccatctccacagggaaagactcaaagtccagcctcagtgctgcccggcccttcagccacggccatggtacttgtgcacaggcctggggcagccttgtgggtaggaggagcccagtgggcttcatttcacggcctagtcctgcccttcccagctgcatgacctgaagcaagttcctgcccgtctctgagcctgttaacatgcaggggatatggtgttcacggtaacctttcttaggaggcagcaaggcctgggtttggcttgtaaaagatttccgtcccaatgcaccctgacggtgggcagcttgagtgtctaaaccttcggccctcagga

SEQ ID NO: 3973 - DNA, 128 bp, Homo sapiens
agggctaaaggtcaaccagccagcctcttttgcagtcagcctgaacggggccaagggggcgatcgatgccaaggtgcacagcccctcaggagccctggaggagtgctatgtcacagaaattgaccaag

SEQ ID NO: 3974 - DNA, 91 bp, Homo sapiens
gtaagtgcgacccgcgggcctcttgctcctggggcctttccgtcctcccttgccctggctcaagcacccccatctaaccatgtctgctgtg

SEQ ID NO: 3975 - DNA, 117 bp, Homo sapiens
acctgggtgtgtgcgacggcagagtgtgggggcaggggcggggatgtgcgcctgtggcttgctgccccttgcaaatcagtggctctccctctttaaaccaagttggacgccagatgg

SEQ ID NO: 3976 - DNA, 205 bp, Homo sapiens
gtgaggcaccgagagaaaccgcccacctggggctcctgggcccggacagaccagagccaccgcagagaccaggccttggccctgtgttcagtgacccccctggcccagctctgggttccaggcctctgctctggccgggtgcagcccacgcttggggtcggcaggaaatatcctgcccaccacgtggagtttttctcgtgtctca

SEQ ID NO: 3977 - DNA, 50 bp, Homo sapiens
tgtggcttctccgtctggcgacgcccgccgcctcactgtttctagccttc

SEQ ID NO: 3978 - DNA, 44 bp, Homo sapiens
ctacgaagtctcagtcaagttcaacgaggaacacattcccgaca

SEQ ID NO: 3979 - DNA, 95 bp, Homo sapiens
gcctgagtgtgggtattggacccagggctggcacagatagccctgcctggcactcactcttcactttgaggtcacagggccacccaggctgttcg

SEQ ID NO: 3980 - DNA, 127 bp, Homo sapiens
aattcagtatctggacccgggaagctggtgctggaggcctggccattgctgtcgagggccccagcaaggctgagatctcttttgaggaccgcaaggacggctcctgtggtgtggcttatgtggtcca

SEQ ID NO: 3981 - DNA, 111 bp, Homo sapiens
gggcaagacccatgaggccgagatcgtggaaggggagaaccacacctactgcatccgctttgttcccgctgagatgggcacacacacagtcagcgtgaagtacaagggcca

SEQ ID NO: 3982 - DNA, 82 bp, Homo sapiens
gggccgggtgaaagagagcatcacccgcaggcgtcgggctccttcagtggccaacgttggtagtcattgtgacctcagcctg

SEQ ID NO: 3983 - DNA, 25 bp, Homo sapiens
tcggcagcccccctcactacaccag

SEQ ID NO: 3984 - DNA, 40 bp, Homo sapiens
tacatcatcaacatcaagtttgccgaccagcacgtgcctg

SEQ ID NO: 3985 - DNA, 88 bp, Homo sapiens
ggctcagcctgtccattgagggccccagcaaggtggacatcaacacagaggacctggaggacgggacgtgcagggtcacctactgccc

SEQ ID NO: 3986 - DNA, 26 bp, Homo sapiens
accgaggctcaggggtatccatcccc

SEQ ID NO: 3987 - DNA, 120 bp, Homo sapiens
ccggtggtgatcagccagtcggaaattggggatgccagtcgtgttcgggtctctggtcagggccttcacgaaggccacacctttgagcctgcagagtttatcattgatacccgcgatgca

SEQ ID NO: 3988 - DNA, 138 bp, Homo sapiens
tcccacctaaaggtcggctctgctgccgacatccccatcaacatctcagagacggatctcagcctgctgacggccactgtggtcccgccctcgggccgggaggagccctgtttgctgaagcggctgcgtaatggccac

SEQ ID NO: 3989 - DNA, 137 bp, Homo sapiens
cattgagggcccgtccaaagcagaaatcagctgcactgacaaccaggatgggacatgcagcgtgtcctacctgcctgtgctgccgggggactacagcattctagtcaagtacaatgaacagcacgtcccaggcagcc

SEQ ID NO: 3990 - DNA, 55 bp, Homo sapiens
ttctatgtggattacgtcaactgtggccatgtcactgcctatgggcctggcctca

SEQ ID NO: 3991 - DNA, 26 bp, Homo sapiens
acacacgaggctgccattccacaagg

SEQ ID NO: 3992 - DNA, 97 bp, Homo sapiens
gtggcgcagcccaccatcactgacaacaaagacggcaccgtgaccgtgcggtatgcacccagcgaggctggcctgcacgagatggacatccgctatg

SEQ ID NO: 3993 - DNA, 28 bp, Homo sapiens
ttcaccatcaagaagggcgagatcacag

SEQ ID NO: 3994 - DNA, 81 bp, Homo sapiens
ctggctggggaccagccctcggtgcagccccctctacggtctcagcagctggccccacagtacacctacgcccagggcggc

SEQ ID NO: 3995 - DNA, 198 bp, Homo sapiens
ccaccattcagattggggaggagacggtgatcactgtggacactaaggcggcaggcaaaggcaaagtgacgtgcaccgtgtgcacgcctgatggctcagaggtggatgtggacgtggtggagaatgaggacggcactttcgacatcttctacacggccccccagccgggcaaatacgtcatctgtgtgcgctttggtg

SEQ ID NO: 3996 - DNA, 95 bp, Homo sapiens
caagacaaccatgacggcacgtatacagtggcctacgtgccagacgtgacaggtcgctacaccatcctcatcaagtacggtggtgacgagatccc

SEQ ID NO: 3997 - DNA, 119 bp, Homo sapiens
aaggtgctgcctactcatgatgccagcaaggtgaaggccagtggccccgggctcaacaccactggcgtgcctgccagcctgcccgtggagttcaccatcgatgcaaaggacgccgggga

SEQ ID NO: 3998 - DNA, 65 bp, Homo sapiens
agccagtggacgtggtagacaacgctgatggcacccagaccgtcaattatgtgcccagccgagaa

SEQ ID NO: 3999 - DNA, 26 bp, Homo sapiens
ggaggcccaggagactagctgatgct

SEQ ID NO: 4000 - DNA, 104 bp, Homo sapiens
cctgagcccaggcatggttcgtgccaacctccctcagtccttccaggtggacacaagcaaggctggtgtggccccattgcaggtcaaagtgcaagggcccaaag

SEQ ID NO: 4001 - DNA, 44 bp, Homo sapiens
tttcaaggtccctgtgcatgatgtgacagatgcgtccaaggtca

SEQ ID NO: 4002 - DNA, 84 bp, Homo sapiens
acggcagctgctcggtcgagtacatcccttatgaggctggcacctacagcctcaacgtcacctatggtggccatcaagtgccag

SEQ ID NO: 4003 - DNA, 388 bp, Homo sapiens
gcgcagctcgagtgcttggacaatggggatggcacatgttccgtgtcctacgtgcccaccgagcccggggactacaacatcaacatcctcttcgctgacacccacatccctggctccccattcaaggcccacgtggttccctgctttgacgcatccaaagtcaagtgctcaggccccgggctggagcgggccaccgctggggaggtgggccaattccaagtggactgctcgagcgcgggcagcgcggagctgaccattgagatctgctcggaggcggggcttccggccgaggtgtacatccaggaccacggtgatggcacgcacaccattacctacattcccctctgccccggggcctacaccgtcaccatcaagtacggcggccagc

SEQ ID NO: 4004 - DNA, 178 bp, Homo sapiens
tcaaatcaaagggtgctggtggtcaaggcaaagtggcatccaagattgtgggcccctcgggtgcagcggtgccctgcaaggtggagccaggcctgggggctgacaacagtgtggtgcgcttcctgccccgtgaggaagggccctatgaggtggaggtgacctatgacggcgtgcccgt

SEQ ID NO: 4005 - DNA, 55 bp, Homo sapiens
taggcgtcaatgtcacttatggaggggatcccatccctaagagccctttctcagt

SEQ ID NO: 4006 - DNA, 134 bp, Homo sapiens
cacagtaaatgccaaagctgctggcaaaggcaagctggacgtccagttctcaggactcaccaagggggatgcagtgcgagatgtggacatcatcgaccaccatgacaacacctacacagtcaagtacacgcctg

SEQ ID NO: 4007 - DNA, 58 bp, Homo sapiens
cccatccgagtcaaggtggagccctctcatgacgccagtaaggtgaaggccgagggcc

SEQ ID NO: 4008 - DNA, 106 bp, Homo sapiens
taggccccgccgaagctgacatcgacttcgacatcatccgcaatgacaatgacaccttcacggtcaagtacacgccccggggggctggcagctacaccattatggt

SEQ ID NO: 4009 - DNA, 97 bp, Homo sapiens
caccccaacaaggtcaaagtatacggccccggagtagccaagacagggctcaaggcccacgagcccacctacttcactgtggactgcgccgaggctg

SEQ ID NO: 4010 - DNA, 87 bp, Homo sapiens
ctgccctgtggaggcgttggtcaaggacaacggcaatggcacttacagctgctcctacgtgcccaggaagccggtgaagcacacagc

SEQ ID NO: 4011 - DNA, 75 bp, Homo sapiens
agaagacaggtgtggccgtcaacaagccagcagagttcacagtggatgccaagcacggtggcaaggccccacttc

SEQ ID NO: 4012 - DNA, 123 bp, Homo sapiens
ggccatcgcaggctaagatcgaatgtgacgacaagggcgacggctcctgtgatgtgcgctactggccgcaggaggctggcgagtatgccgttcacgtgctgtgcaacagcgaagacatccgcc

SEQ ID NO: 4013 - DNA, 38 bp, Homo sapiens
cacctggggacagacgatggcaaggacggcccaccctg

SEQ ID NO: 4014 - DNA, 77 bp, Homo sapiens
ggcgtgtatggcttcgagtattaccccatggtccctggaacctatatcgtcaccatcacgtggggtggtcagaacat

SEQ ID NO: 4015 - DNA, 104 bp, Homo sapiens
ctgtaacccgagtgcctgccgggcggttggccggggcctccagcccaagggtgtgcgggtgaaggagacagctgacttcaaggtgtacacaaagggcgctggca

SEQ ID NO: 4016 - DNA, 148 bp, Homo sapiens
aggtcgaggttgtgatccaggaccccatgggacagaagggcacggtagagcctcagctggaggcccggggcgacagcacataccgctgcagctaccagcccaccatggagggcgtccacaccgtgcacgtcacgtttgccggcgtgcc

SEQ ID NO: 4017 - DNA, 99 bp, Homo sapiens
gccccttcgaggtgtacgtggataagtcacagggtgacgccagcaaagtgacagcccaaggtcccggcctggagcccagtggcaacatcgccaacaaga

SEQ ID NO: 4018 - DNA, 61 bp, Homo sapiens
aaagtgaccgccaataacgacaagaaccgcaccttctccgtctggtacgtccccgaggtga

SEQ ID NO: 4019 - DNA, 116 bp, Homo sapiens
acgtggacgagcactctgtcatgacctacctgtcccagttccccaaggccaagctgaagccaggggctcccttgcggcccaaactgaacccgaagaaagcccgtgcctacgggcca

SEQ ID NO: 4020 - DNA, 94 bp, Homo sapiens
tgtgtcctgactgggactcttgggacgccagcaagcccgttaccaatgcgcgagaggccatgcagcaggcggatgactggctgggcatccccca

SEQ ID NO: 4021 - DNA, 199 bp, Homo sapiens
aggccatcgtggacgggaacctgaagctgatcctgggcctcatctggaccctgatcctgcactactccatctccatgcccatgtgggacgaggaggaggatgaggaggccaagaagcagacccccaagcagaggctcctgggctggatccagaacaagctgccgcagctgcccatcaccaacttcagccgggactggca

SEQ ID NO: 4022 - DNA, 370 bp, Homo sapiens
atgagtagctcccactctcgggcgggccagagcgcagcaggcgcggctccgggcggcggcgtcgacacgcgggacgccgagatgccggccaccgagaaggacctggcggaggacgcgccgtggaagaagatccagcagaacactttcacgcgctggtgcaacgagcacctgaagtgcgtgagcaagcgcatcgccaacctgcagacggacctgagcgacgggctgcggcttatcgcgctgttggaggtgctcagccagaagaagatgcaccgcaagcacaaccagcggcccactttccgccaaatgcagcttgagaacgtgtcggtggcgctcgagttcctggaccgcgagagcatcaaactggtgtcca

SEQ ID NO: 4023 - DNA, 87 bp, Homo sapiens
cgcgcgcctaggtgcctgcgactttaattaaagggccgtcccctcgccgaggctgcagcaccgcccccccggcttctcgcgcctcaa

SEQ ID NO: 4024 - DNA, 107 bp, Homo sapiens
gcggacgccgacagaatccccgaggcgcctggcgcgggcgcgggcgcgaaggcgatccgggcgccaccccgcggtcatcggtcaccggtcgctctcaggaacagcag

SEQ ID NO: 4025 - DNA, 32 bp, Homo sapiens; identical to SEQ ID NO: 2553

SEQ ID NO: 4026 - DNA, 42 bp, Homo sapiens; identical to SEQ ID NO: 3920

SEQ ID NO: 4027 - DNA, 27 bp, Homo sapiens
tcatctgtccacctggctccaaagaca

SEQ ID NO: 4028 - DNA, 42 bp, Homo sapiens
gtactccccctgtgtgccacaaatgcactacgttattaaatt

SEQ ID NO: 4029 - DNA, 104 bp, Homo sapiens
agcacagtctgaatctgcacagagcaagatgctgagtggagtcgggggctttgtgctgggcctgctcttccttggggccgggctattcatctacttcaagaatc

SEQ ID NO: 4030 - DNA, 170 bp, Homo sapiens
attgaagtcaggtggttccggaacagccaggaagagaaggctggggtggtgtccacaggcctgattcagaatggagactggaccttccagaccctggtgatgctggaaacagttcctcgaagtggagaggtttacacctgccaagtggagcacccaagcgtgacgagccc

SEQ ID NO: 4031 - DNA, 52 bp, Homo sapiens
accctgcagcaccacaacctcctggtctgctctgtgaatggtttctatccag

SEQ ID NO: 4032 - DNA, 32 bp, Homo sapiens
ctaaggtgactgtgtatcctgcaaggacccag

SEQ ID NO: 4033 - DNA, 57 bp, Homo sapiens
ggtgcggttcctgcacagagacatctataaccaagaggaggacttgcgcttcgacag

SEQ ID NO: 4034 - DNA, 26 bp, Homo sapiens
gtttcttgcagcaggataagtatgag

SEQ ID NO: 4035 - DNA, 25 bp, Homo sapiens
atggcaaagctgacagtgacactga

SEQ ID NO: 4036 - DNA, 30 bp, Homo sapiens
gtgtgtctgaagctccctggaggttcctac

SEQ ID NO: 4037 - DNA, 45 bp, Homo sapiens
ctgaagtgcacatgaccacattcaaggaagaaccttctgccacag

SEQ ID NO: 4038 - DNA, 80 bp, Homo sapiens
agatgctgagtggagtcgggggctttgtgctgggcctgctcttccttgggacagggctgttcatctacttcaggaatcag

SEQ ID NO: 4039 - DNA, 37 bp, Homo sapiens
tcaaccaccaagaaggggactgtgctaatccctgagc

SEQ ID NO: 4040 - DNA, 99 bp, Homo sapiens
ctgcggtggtctccataggcctgatccagaatggagattggaccttccagaccctggtgatgctggaaacagttcctcggagtggagaggtttacacct

SEQ ID NO: 4041 - DNA, 31 bp, Homo sapiens
ccatcctaaggtgactgtgtatcctgcaaag

SEQ ID NO: 4042 - DNA, 166 bp, Homo sapiens
actcgcttctgtgccggccgccagaaggtttgctgagggcaatcactccctggtgccgggctccttgaggttatgcactgggacatctagagcctattgtttgaggaatgcagtcttgcaagcctgctctggatcaagccacagactgaaacacccccgaagagca

SEQ ID NO: 4043 - DNA, 28 bp, Homo sapiens
tctgtattcaccctgtatgacaaacaca

SEQ ID NO: 4044 - DNA, 27 bp, Homo sapiens
gtgagtggtttctatccaggcagcatt

SEQ ID NO: 4045 - DNA, 26 bp, Homo sapiens
ctaaggtgactgtatatccttcaaag

SEQ ID NO: 4046 - DNA, 27 bp, Homo sapiens
tacttctataaccaggaggagtccgtg

SEQ ID NO: 4047 - DNA, 40 bp, Homo sapiens
ctggaggctcctgcatgacagcgctgacagtgacactgat

SEQ ID NO: 4048 - DNA, 31 bp, Homo sapiens; identical to SEQ ID NO: 1466

SEQ ID NO: 4049 - DNA, 36 bp, Homo sapiens
gacaagatggacgactactgcagatacaattacggg

SEQ ID NO: 4050 - DNA, 157 bp, Homo sapiens
gctaagtgtgagtgtcatatcttcaatgggatgaagcgggtgcagtacctgaacagatacatccataaacgggaggagaacctgcgcttcgacagcaacgtggaggagttccaggcagttacggaactggggcggcctgtcgcagagaactggaaca

What is claimed is:

1. A method for treating a subject with muscle-invasive bladder cancer, the method comprising:
  a) obtaining or having obtained an expression level of a plurality of genes in a biological sample obtained from a subject with muscle-invasive bladder cancer, wherein the plurality of genes are selected from Intercept, TMEM45B, ERBB2, TNFRSF21, FLRT3, SPINK1, LRRC37A2, SCCPDH, UGT1A3, ZNF486, UGT1A8, PPARG, UGT1A1, AHR, EPCAM, PVRL4, UGT1A4, IGFBP3, S100P, PTPRM, NQO1, RNF138P1, CPSF6, GATA3, UGT1A5, UGT1A10, ELF3, AGR2, EHF, SLC14A1, CXCL17, TMSB10, CCL5, MMP12, SAT1, CD68, ANXA1, IFITM2, KRT5, GJB2, MT1L, NDRG1, ASPN, SULF1, EFEMP1, G0S2, TIMP3, MUC16, GBP1, CGB2, SNAI2, DDIT4, CTSK, GBP5, C3, VIM, BGN, TGFBI, TIMP2, SAA1, LAMC2, FBP1, BAMBI, PAQR7, IGFL1, TMPRSS2, PLXNB2, MAL, TBX3, CRISP3, SCNN1B, RNF128, KRT7, KRT8, ADAM10, SNX31, KRT18, UPK3A, PSCA, UPK2, AHNAK, SPP1, TWIST2, SPARCL1, CASP14, MMP1, LAPTM5, MMP13, DUSP1, HIST1H2BF, GABRP, CFH, SFRP2, SERPINB3, MGP, FGFBP1, SAMD9, ITGA6, MALL, MYL9, IER3, SPRR2F, MMP2, HLA-DRA, DCN, TPM2, HLA-A, LYZ, LUM, COL3A1, POSTN, IFI30, CD74, VCAN, CALD1, COL1A2, HLA-DRB5, OLFM4, THBS2, KRT23, MYH11, CLDN1, RARRES1, HPGD, ACER2, RALBP1, GSTM3, BTBD16, MACC1, SEMASA, ACOX1, GSTM2, CYP4Z2P, ZNF91, STS, TOX3, PLP2, TACSTD2, ATP8B1, GRHL3, TNC, TPX2, DSP, TIMP1, UPK1B, DHRS2, PTN, SNCG, ACTG2, and SYTL2;

b) subtyping the muscle-invasive bladder cancer of the subject according to a genomic subtyping classifier based on the expression level of each of the plurality of genes, wherein said subtyping comprises assigning the muscle-invasive bladder cancer to one of four subtypes selected from the group consisting of a claudin-low subtype, a basal subtype, a luminal-infiltrated subtype, and a luminal non-infiltrated subtype; and c) administering neoadjuvant chemotherapy to the subject when the subtyping of step b) indicates that the subject has the basal subtype and administering an anti-cancer treatment other than the neoadjuvant chemotherapy to the subject when the subtyping of step b) indicates that the subject has the luminal-infiltrated subtype, the luminal non-infiltrated subtype, or the claudin-low subtype, wherein the anti-cancer treatment other than neoadjuvant chemotherapy is selected from the group consisting of surgery, radiation therapy, immunotherapy, biological therapy, hormonal therapy, and photodynamic therapy.

2. The method of claim 1, wherein the neoadjuvant chemotherapy comprises administering cisplatin.

3. The method of claim 1, wherein the biological sample is a biopsy.

4. The method of claim 1, wherein the biological sample is a urine sample or a bladder tumor sample.

5. The method of claim 1, wherein the biological sample is a transurethral resection (TUR) specimen.

6. The method of claim 1, wherein the subject is a human being.

7. The method of claim 1, wherein the level of expression is increased or reduced compared to a control.

8. The method of claim 1, wherein said level of expression is obtained by performing in situ hybridization, a PCR-based method, an array-based method, an immunohistochemical method, an RNA assay method, or an immunoassay method.

9. The method of claim 8, wherein said level of expression is obtained by using a reagent selected from the group consisting of a nucleic acid probe, one or more nucleic acid primers, and an antibody.

10. The method of claim 9, wherein said level of expression is obtained by measuring the level of an RNA transcript.

11. The method of claim 9, wherein after administering neoadjuvant chemotherapy to the subject when the subtyping of step b) indicates that the subject has the basal subtype, the method further comprises administering one cancer treatment selected from the group consisting of surgery, radiation therapy, immunotherapy, biological therapy, hormonal therapy, and photodynamic therapy.

* * * * *

UNITED STATES PATENT AND TRADEMARK OFFICE
CERTIFICATE OF CORRECTION

PATENT NO.      : 11,208,697 B2
APPLICATION NO. : 15/875871
DATED           : December 28, 2021
INVENTOR(S)     : Elai Davicioni et al.

It is certified that error appears in the above-identified patent and that said Letters Patent is hereby corrected as shown below:

In the Specification

At Column 5, Line 6, delete "SEMASA," and insert -- SEMASA --.

At Columns 51-52, Line 15 of "TABLE 1 – continued", delete "PT3/4" and insert -- pT3/4 --.

In the Claims

At Column 465, Line 56, delete "Intercept,".

At Column 466, Line 56, delete "SEMASA", and insert -- SEMA5A --.

Signed and Sealed this
Ninth Day of July, 2024

Katherine Kelly Vidal
*Director of the United States Patent and Trademark Office*